United States Patent 12,577,609 (METHODS FOR CELL-TYPE SPECIFIC PROFILING TO IDENTIFY DRUG TARGETS) - sequence listing, part 13

SEQ ID NO: 17066 - DNA, 1040 bp, Homo sapiens
  ENST00000498474
cttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggg

SEQ ID NO: 17067 - DNA, 825 bp, Homo sapiens
  ENST00000540122
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatgg

SEQ ID NO: 17068 - DNA, 9069 bp, Homo sapiens
  ENST00000395699
ggcggcctagaagatggcggacggcgacagcggcagcgagcgcggcggcggcggtgggccgtgcgggttccagcccgcgtcccgcggcggcggcgagcaagagacgcaggagctggcctcgaagcggctggacatccagaacaagcgcttctacttagatgtgaagcagaacgccaagggccgcttcctcaagatcgccgaggtgggcgcgggcggttccaagagccgcctcacgctgtccatggcggtggccgccgagttccgcgactcgctgggcgacttcatagaacactacgcgcagctgggccctagcagccccgagcagctggcggctggcgccgaggagggcggcgggccgcggcgcgcgctcaagagcgaattcttggtgcgtgagaaccgcaagtactacctggacctcaaggagaaccagcgcggccgcttcctgcgcatccgccaaacggtcaaccgcggcggtggcggcttcggcgcgggccccgggccgggcggcttgcagagcggccagaccatcgcgctgcctgcgcagggcctcatcgagttccgcgacgcgctggcgaagctcatagacgactacggaggcgaggacgacgagctggcaggcggcccgggaggcggcgccgggggcccagggggcggcctgtatggagagctcccggagggcacctccatcaccgtggactccaagcgcttcttcttcgatgtgggctgcaacaaatacggggtgtttctgcgagtgagcgaggtgaagccgtcctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtatatagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttctttcctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatttgagattccaaatgcggccgggcgtggtggctcacgcctgtaatcccagcactctgggaggctgaggtgggcgggtcagttcaggtcagcctggacaacatggtgaaaccccgtctctactaaaaatactaaaattagccgggcatggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaatgacaa

SEQ ID NO: 17069 - DNA, 422 bp, Homo sapiens
  ENST00000630974
ccgggctccctcagccctccaatggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctg

SEQ ID NO: 17070 - DNA, 530 bp, Homo sapiens
  ENST00000628536
acttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacggtgggtagccgtgacctggggtctgggcatattgtggatcttggggtgttggatgcgaaaagtttgaagctatgtctgtcacaaggaagggatgatatgggggtccctcactcccccagattagaagacaaaaagcagtccattaggtctgagagctctgccacatactccagacaaaggaaaactggtgtatttt

SEQ ID NO: 17071 - DNA, 470 bp, Homo sapiens
  ENST00000628345
aggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 17072 - DNA, 569 bp, Homo sapiens
  ENST00000625893
acttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 17073 - DNA, 595 bp, Homo sapiens
  ENST00000620986
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 17074 - DNA, 568 bp, Homo sapiens
  ENST00000627445
cgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactgagtagcaactctgtgcccggcaatggaagagaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcaga

SEQ ID NO: 17075 - DNA, 569 bp, Homo sapiens; identical to SEQ ID NO: 17072
  ENST00000417718

SEQ ID NO: 17076 - DNA, 595 bp, Homo sapiens; identical to SEQ ID NO: 17073
  ENST00000216200

SEQ ID NO: 17077 - DNA, 568 bp, Homo sapiens; identical to SEQ ID NO: 17074
  ENST00000406910

SEQ ID NO: 17078 - DNA, 422 bp, Homo sapiens; identical to SEQ ID NO: 17069
  ENST00000404171

SEQ ID NO: 17079 - DNA, 530 bp, Homo sapiens; identical to SEQ ID NO: 17070
  ENST00000467935

SEQ ID NO: 17080 - DNA, 470 bp, Homo sapiens; identical to SEQ ID NO: 17071
  ENST00000443735

SEQ ID NO: 17081 - DNA, 1697 bp, Homo sapiens
  ENST00000477592
catggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgcccttattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactctactttg

SEQ ID NO: 17082 - DNA, 1538 bp, Homo sapiens
  ENST00000380277
tgcaaagccgacggatagaacctgtgatgggaagacttctgctctgcgcttctcatggggagatagaaaagcacccgagccttcatgcctcgagctatggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 17083 - DNA, 2190 bp, Homo sapiens
  ENST00000380283
ttcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccgcgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 17084 - DNA, 532 bp, Homo sapiens
  ENST00000485986
ggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaagacctattcaacgaattgcttgaaaactgaacaggcttttcccctgcaaaacaaaatcagaccagaacttctgaaaaagttagtctccgtgaccaataatactaggcacgtttgcatcagcctcggtcacacaagtgtgggggagacgccagtgtccttgggcacctacttccccatccctgcaaagccgacggatagaacctgtgatgggaagacttctgctctgcgcttctcatggggagatagaaaagcacccgagccttcatgcctcgagctatg

SEQ ID NO: 17085 - DNA, 6808 bp, Homo sapiens
  ENST00000252804
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatgga

SEQ ID NO: 17086 - DNA, 2796 bp, Homo sapiens
  ENST00000493654
ccacaatgctggacttccttccaccctcaggatgaacgggcagctccctgggtggcagcgctgggtctgagaaatgtggatgttccttgtgattttgcagctgctgacagcacagggtgtgtgccgtctgtggtcatttccctgcaccccatgtgtgcagaggtgttcgtgtatcttggtgactgcagaggcacacacaggccggcgtggtcactgcttctctctggctgtgaattaaagcaggtcagccgcagacacagaggtgacatgcaggtcacctggaacctctgcagaccgtcctggctgccacccctaagtgctctctggcccctgtgccactgttcctgaggcttcctttttttttttttttcccccatggtttcagctagaaagttctaagctttgataacttaagtgccagttgctaatgaatgaggcatgcaggaaagatggctttcatttagaagccgtatctgaggcatttcccaaagtgagtaactgtttggctagttaggtcctagatgtccagctgtcattatgaaatgcagatggtacggtgaggggacgtccacctttttcagcatgatgtgtgcataggtgagacactgctgctgcacaggttggggaccacacacttatggctgacaggagatcaaagaagatgttttaattgacatgagtaagtgggtggcttgctgaagttattcacagccatcatcagacagccttacctgtggctgagcatgctttatgaaggcttattagaagaattgggatatttatgataaataatttgtgttcatttcagacatcacagacagtttaggttcaaatgcaagggacggaaaactccaaatccaggatggttttaatgaggtgcgagtttacttttccctcagtcgtggagattgctggaccctccgcagtgcagggtccctgctgcagcttggtgctgtactgtgggtggcctcttcccaaggtcacctcatggcccaggcatttccggccactgtcaccctgtctgccccccggccctgcaagatgcaagagagggtttgaggaaggagacccttccaggaggcttctgctacccctgtgcatggcacagcggttggaaaggtcaccttgttatggggccccgtgcttccagagaaaagccagtggtgttgttactcggaaaataaggcagacttgactctggggattctgagtgatcatcgttcgttctggtggaagtgtaggtgcaggacgttctcgtcatctggttgaatcttgctcccacagtcctctgagaacgtcgcctttgtgactacggtttttatttgacagcacggtggtgggaatgtcttccattggggcgtgtggtcagctgccgccagtctaataaggacattggagattctgtaaaagttcttcagaaatattcccctcaaatgttgtttattttaaggcattattttcagtgaaataacatcttttaatacaagagccaagctgttactctgaagtgcccaatgaatgaatgttctttgcattgctgcagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgtt

SEQ ID NO: 17087 - DNA, 3840 bp, Homo sapiens
  ENST00000478155
gctgggacggcgtcctcaggagcctggagcgccatgcagctgctgacacagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccaggaacagcagccctatttagtatactagtctgagcatgtgggtgtagctccctcagatacacatgaagagtctcccgccatccggtgcacagggagtcactgcagcatgggggaaccagccctgagaagcccagaagcctaggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggaggtaagacccaggccggccctttgcctgctccctccgcggccacagacgcaggaagcacacatttccactgtgcccaggcaaccccagcgtgttctggacagggctgagctgggactggattccacaggaccaaggcactgggaagcgcagaggtgtctgcacatcccccgcggcttcctgtccatgcatggccgtccctcatggacatcatggcaggaaactctgagaagctctgtcattgcggaagagacttggggttcctgcctttgactccctcacacctgccttgtttcagatagtctctaggatgtgcttttaagtagcctcttgaaggaatctatttgcatggaggatagaattttctggaaacagtcgaggaatatattgaaacagacgaatagcttttgctctgactttgcttcccagagccctcactgtcacctccccattcggcatcatgacctttcatcacattctttgcctacagtcctagccctctttcttcaatgggaaagtcgctgggcatgttactgcataaaggcacagcctggatgggggttggggtgagggcaggagctgaaactgctggagaaggagctacgcagacctcctggttcctgtcctgggatgcaagcagtgaccctgagacatcctggccactccagcttgcaccaaatggccagcccatcccttcagccctctgaggggccccacccagggctcctgaaagtctttggggaggaggcttgtgcctgcatcacacgccctggatttcccttttctcaggcagttatgggcaagaacaggagaggtttatcccggaaaggaacttgctggggcctcgcttggctcttcgtcatctccagcactcaatcctctccctggttctcccagctggccatccaccccgctctgactccccgagtccccatgtcctcctggccccctgtgtagtgcttttccctctgttctctgccactgtcaacccctctgtctgagttacgggtgcagggacgttcaggtgtcaccatggtgtctgctggggaggcaaagatttgcttatgcagggccaggccaaattatccggcgccccgacccaggtggagacaagcttctgtggtcatgctgtcagtctgagagcaggagttctccatgcgtccgagtgtccagtgtaacgggcccatgcccttgcagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatt

SEQ ID NO: 17088 - DNA, 740 bp, Homo sapiens
  ENST00000453308
ggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattgg

SEQ ID NO: 17089 - DNA, 570 bp, Homo sapiens
  ENST00000477093
aaagatgcatgaccatcagagaccatggggccaggaggacttcacagggcagaggggttgccttcggcagactgtagagattgtgtagttctcatctactttgtgtttcacggccgcacggcgagtggatggcgtggcgttggcctgggctcgcctctgctgcccatccccagccgtgggacattccggaactgcgaggtctcttccctggaggaagctccttggattcaggtggaggctttagactctggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctcc

SEQ ID NO: 17090 - DNA, 772 bp, Homo sapiens
  ENST00000493779
tgtctgtttgttttgtttttgttttgttgcctcccacttcggatgaggaaggtatagtacattatgttgtagaaagtagccgtagaaatattaatagcaatgattatattttggggtactatgaattttatcttcagtaatttgtttcattcttcctttcttccccctaaactctggttagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagca

SEQ ID NO: 17091 - DNA, 534 bp, Homo sapiens
  ENST00000465809
tgtcttccggtttttgtctgtttgttttgtttttgttttgttgcctcccacttcggatgaggaagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacg

SEQ ID NO: 17092 - DNA, 2643 bp, Homo sapiens
  ENST00000433670
ccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctagggaagagttccagcattttctttcccactgtgcttatgaactgtgaaattatttccttaaactgtgattcctcttgagccctacagccctgtcgctctcactttggtttaataggaatctctgggggacgtgaagtcccttggagtgctgatcaggctacagcaggtccacctgccctgagtgggttatgccatcctggccagggtgggttatgcaagcccagtccctctgcaacaaatgagccataagggaggacttggcagcgtgcttgctccctgagtgacgttgtgtcctgggaatgcggtgccacgcgtattaggagggttgttttggaagagtcccgggtctgtgaaaccagctgatgagatcacctcgggctggtgtggagatgctgttgggggaggtatgtcccccactcactctgctctggcactttgccgttgcccagtaaataacagatgcctttacatgt

SEQ ID NO: 17093 - DNA, 567 bp, Homo sapiens
  ENST00000467191
gtcctcaggagcctggagcgccatgcagctgctgacacagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggca

SEQ ID NO: 17094 - DNA, 593 bp, Homo sapiens
  ENST00000483018
gacacaggttcgctcagctcccgtgtggatctaacttgtctcccaaacaaaggaagtcttctcttgtgtccacaaacatgctgtggacctgttaaggctaagacggccctggctgcggctgtcagggtgacggagggaagtcctaccgctgaccattacatgcgtcctggcagcgagccccacctgtgagccagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaa

SEQ ID NO: 17095 - DNA, 543 bp, Homo sapiens
  ENST00000477810
actgttgttggcagccttgacctggggcattgtgaccaacctgagtgggtgcgggaggggccctgacctctgctgggacggcgtcctcaggagcctggagcgccatgcagctgctgacacagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagacagagtctcgctgttgcccaggctggagtgcagtggtaagatctcagctcactgcaacctctgactccctggttcaagtgattctcctgcctcaacctgccgagtagctgggactacagctcgacccacttttgtaatccagccacagaatacagaggtgctggttggggagagcgtcacgctggagtgcagcgccacaggccaccccccgccgcggatctcctggacgagaggtgaccgcacacccttg

SEQ ID NO: 17096 - DNA, 588 bp, Homo sapiens
  ENST00000447941
tggaagctggttcccttctgcaccaggactgagcacaacggtgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccc

SEQ ID NO: 17097 - DNA, 720 bp, Homo sapiens
  ENST00000425171
ggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatca

SEQ ID NO: 17098 - DNA, 519 bp, Homo sapiens
  ENST00000485177
ttaaggcgccaactaaaaaacccgtagtgagcgcaggcagaaaccacggagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaat

SEQ ID NO: 17099 - DNA, 2258 bp, Homo sapiens
  ENST00000522628
aacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaat

SEQ ID NO: 17100 - DNA, 1925 bp, Homo sapiens
  ENST00000522933
atgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagactgtaggagtagaggacagttcagagcagtgacgcaagagtctcaaaagaaacgctcagctcaatacagctatcctgttgataaggatatggagttaagtcatctaagaagtaggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaa

SEQ ID NO: 17101 - DNA, 4805 bp, Homo sapiens
  ENST00000356297
agtccagcagccaccatcaccaccactgcggttgctgctgcagctgcagctgctgctctccctccggctgcttcttcgcgtggccagcagcgaatggagcgatggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagactgtaggagtagaggacagttcagagcagtgacgcaagagtctcaaaagaaacgctcagctcaatacagctatcctgttgataaggatatggagttaagtcatctaagaagtaggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaa

SEQ ID NO: 17102 - DNA, 768 bp, Homo sapiens
  ENST00000519183
catgaatttataatagagaaagcagcttccctacctggctactggataatatgttatattaaatttgtcactgctctttcactgtttaaagtgaaatgaagaattcgttagcaaaagaaatactttaaggtctaaataatatatcaaatatatatgtaatacaacatgaaatttcctttatgtcataagaaatactttcttattattttagataaattacatgaaccagatgtgacactctggattatcatcttatctgccatttaattttaattttgaattccactcataccattttccttttaagatcacaaagaacaccaatcacaatgccttgtacatgccaaatgaccaaagaagatttgatgatattttaaaattctcacacgacttttatttttcagcattttatttgcttcttgttataaataggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcag

SEQ ID NO: 17103 - DNA, 2037 bp, Homo sapiens
  ENST00000356151
ggggcggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 17104 - DNA, 1653 bp, Homo sapiens
  ENST00000468776
ggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagcca

SEQ ID NO: 17105 - DNA, 2825 bp, Homo sapiens
  ENST00000463280
agcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaa

SEQ ID NO: 17106 - DNA, 1756 bp, Homo sapiens
  ENST00000383715
cggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatcttt

SEQ ID NO: 17107 - DNA, 2031 bp, Homo sapiens
  ENST00000484288
gaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcacccagtgacttcatctatattcatttcattttcatcatgaccttcaaaatcttcattttcactctgatttcagttttaaaatacagctctaaaacctgcaaatcaactgcatggcattttggtatattttaattttggaaaccataactctcaaagtcccgttgctgcaaaaatgttgattcctagttactctgatgaagaggaaagagtgttaggcacttgag

SEQ ID NO: 17108 - DNA, 2817 bp, Homo sapiens
  ENST00000479241
ctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaag

SEQ ID NO: 17109 - DNA, 1610 bp, Homo sapiens
  ENST00000477308
ggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagcca

SEQ ID NO: 17110 - DNA, 583 bp, Homo sapiens
  ENST00000491164
accgcagctcccggcgccgcggggtggaaggagctcggcggcgaccaggaaagcgactccgagttggggggcgggggcgggggctgcgggattcccgggctcaccttggactaggggagcaggaacgagaccgctcaggaccatccacttctgcccgccgccagccttttcctttttgaggccgtgtaatttcctccttgcagctgagggtctgggtgatggggatgagggtgtgccgggccaaatgaagtgtgactccagagcctacttgttgggacagcagagtgtaagtggctggggtctgcagccccgtttccaggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 17111 - DNA, 1852 bp, Homo sapiens
  ENST00000479134
catttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaat

SEQ ID NO: 17112 - DNA, 2171 bp, Homo sapiens
  ENST00000459676
aattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcaggttagtgatggagtaaagtgacatgccaccttcctgtccgccaacaggaggagcgggctgtgcctcttcctgccttggcccaacaatttcaggggttagatagcagcagctttctcaagagaaatcagtgggagtgcaaattagcagtgtcatttgggagagctgaggggctagatttccaagctcggctttcacagggaatggaccggtttcagggccactagccacccccgggctccagcttgctgtctttgctgaaaagcttcatgcagagcttctcagattggagcctgtcttggtacatgcttagctgaacaacacaaatgcgccgtggcccaggggtcccgtcctgccaggcctctctcctcagggagcccgtccatagggtcagttttgtcacagagcacaactggtaagatgcctaggtggaggagtgaaagagtcactgcgtttctgattttctggcaacgatttgactctgttttgctctgtaatgtatttaattatctgaatatttttctgttattagcctttgcttcacttttgtaaattagatactagttttgattgaaaaatgtaaaaagaatttatcttggagactgcttataaaaataatccccaattttgttgagtagccccataatactatcttttatttttgaaccaagatgtctctcctaaagtcttttgcaagcccaataaaaacaattgggacaccagtatctccttttgcttcttaaatgaaccagttgttccagatgtgcgaggagctgcttctgccactcagagcttgctggctgtgcctggaagggttcctacaagctgtgtgaagggagaatcattggcagggagttggtatatgagttgatcccatattcattattaataactaacacagcacccaggagctgccaagagcattcttcagctccactcaaatgcttctaactgaccctcctaagaaaatgagagcaaggggactagtgtgaatgacttacttctggctgagggtggctactggtgccttactgctgaatgttctagggcctgttttgggtagcaaagtacctggtccatgggaggatattcttgtccttatctttgtcagcagatttcccaagaaagcccccaaatgttgatcaagacagaaaataggccttttttgtcttttatggagatacactgtttaggctgatcagaaatgtctggtgatctactgcccggactatattaagccattttctagaagataggatattaatttaacaccacttgggcatattaagaaaattggagaaaattagtagtgagaatccagaaatcctcctttaacaagcaaggcacttgaggcgtctgtttaagggttcacagcccctgtctgtgtggttagatctgcccctgctcacttgactgccggttcttatctctaaatgcctttgggaatttacaatttatttggacttttggggggaattctctaatttatctgtgtttaaatgggtgctgtctcatacagtagtaagtttgcgtgagataaggtaacttttagaatgagagaaaaaaa

SEQ ID NO: 17113 - DNA, 437 bp, Homo sapiens
  ENST00000495557
gactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagc

SEQ ID NO: 17114 - DNA, 590 bp, Homo sapiens
  ENST00000493474
aagaagtcaaaacgatctgctcttgaaaatagtgaagagcattcagcgaagtacagcaactccaataattcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctt

SEQ ID NO: 17115 - DNA, 3035 bp, Homo sapiens
  ENST00000383716
gtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 17116 - DNA, 1974 bp, Homo sapiens
  ENST00000302779
ggggcggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 17117 - DNA, 3807 bp, Homo sapiens
  ENST00000458477
ttcccctgtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 17118 - DNA, 3785 bp, Homo sapiens
  ENST00000228307
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 17119 - DNA, 3683 bp, Homo sapiens
  ENST00000424649
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 17120 - DNA, 4132 bp, Homo sapiens
  ENST00000637624
gatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggtggcgaggagatgcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctctccctcctttcttctccccaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcagaaggtccgctgccctcttgcttttctgtgggtccacccatgtctgctccttcctcgactggtcctcagtactgccccgggctcccatcgaggaaagaagccactccagaagggagaccagaaacctgtctcctcccttccagcccccaggcccagcgcccgatccagggcctggagcaaagagcggatggggagcggtgctgggcggccggctggcctcgggacggcgggcggagcagccccggagggcaggacgagggagggggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttc

SEQ ID NO: 17121 - DNA, 4112 bp, Homo sapiens
  ENST00000536957
tttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttc

SEQ ID NO: 17122 - DNA, 5457 bp, Homo sapiens
  ENST00000323871
ggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagaccagctcctccactgtggctctgagtgccccggggctgtccagctctgctccgtcctcatactgctcccttcctccttctcctcctcccatgccatctgtatttctgccacccaccactataccctcccctcgaggccagggccacactccggagttcccttgtactgagcagagtggacgaggccttctacctcctgtagcccccagctggcttgatttggctggtcttggggtgatgcctgacaccttcaactcaaggtctccctctgtggagggttctctgtgggcagtgggcacagagagtcagggtcgagattggaggcacctgccgaccatcacaagtgagctctctggggctccccgctgccacactgtaccctgtgctgggagcacagctctccaagagcctggggagccccaggggccaccagccagcccttcgtgcccagaggaggccttggctgccacatgggagcagccatgggcttcggaggtattcgggcctgagagaatgcccccctctggagctgctcgaagcttccaagaagtaacagagccagctgtagtggcagtggaccggcaggccatcttcccagatacctggactctcacggaggaacatggcctacagcaggagaggccaaggccagagccagggaggctgggaagcagctcccctgcctcagttaccacggagcagctaggtgcaaagatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggtggcgaggagatgcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctctccctcctttcttctccccaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgatt

SEQ ID NO: 17123 - DNA, 1805 bp, Homo sapiens
  ENST00000538144
acgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctag

SEQ ID NO: 17124 - DNA, 3246 bp, Homo sapiens
  ENST00000637617
atggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagaccagctcctccactgtggctctgagtgccccggggctgtccagctctgctccgtcctcatactgctcccttcctccttctcctcctcccatgccatctgtatttctgccacccaccactataccctcccctcgaggccagggccacactccggagttcccttgtactgagcagagtggacgaggccttctacctcctgtagcccccagctggcttgatttggctggtcttggggtgatgcctgacaccttcaactcaaggtctccctctgtggagggttctctgtgggcagtgggcacagagagtcagggtcgagattggaggcacctgccgaccatcacaagtgagctctctggggctccccgctgccacactgtaccctgtgctgggagcacagctctccaagagcctggggagccccaggggccaccagccagcccttcgtgcccagaggaggccttggctgccacatgggagcagccatgggcttcggaggtattcgggcctgagagaatgcccccctctggagctgctcgaagcttccaagaagtaacagagccagctgtagtggcagtggaccggcaggccatcttcccagatacctggactctcacggaggaacatggcctacagcaggagaggccaaggccagagccagggaggctgggaagcagctcccctgcctcagttaccacggagcagctaggtgcaaagatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctag

SEQ ID NO: 17125 - DNA, 513 bp, Homo sapiens
  ENST00000550795
catcgaggaaagaagccactccagaagggagaccagaaacctgtctcctcccttccagcccccaggcccagcgcccgatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggcc

SEQ ID NO: 17126 - DNA, 621 bp, Homo sapiens
  ENST00000637386
agtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcagatccagggcctggagcaaagagcggatggggagcggtgctgggcggccggctggcctcgggacggcgggcggagcagccccggagggcaggacgagggagggttcatggcccaggggaagacagggagcagctca

SEQ ID NO: 17127 - DNA, 1004 bp, Homo sapiens
  ENST00000547983
gcgttccgttccgggccgaggctcgcggcggaaaagttgcggggcatagacgagcggccccgggacgggcagctagcgcgaccctgagccggcgcccgtggtccggccatggacgacctcgattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatgg

SEQ ID NO: 17128 - DNA, 588 bp, Homo sapiens
  ENST00000551327
gtattctagctgacgacactgaagcacagagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagcccct

SEQ ID NO: 17129 - DNA, 957 bp, Homo sapiens
  ENST00000543331
agctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcaggtaacaaagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggc

SEQ ID NO: 17130 - DNA, 729 bp, Homo sapiens
  ENST00000546532
agagacaggaagccaggcctcctccatgggacccggagggcggggcgggctgtaggacctgaacttccttggaggtcaggcgaccagacccggggtcctgggccttggaacagacatcccctctgtccatctgggcaggagcatgggattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagc

SEQ ID NO: 17131 - DNA, 655 bp, Homo sapiens
  ENST00000548912
agttccggtttgctagagacaggaagccaggcctcctccatgggacccggagggcggggcgggctgtaggacctgaacttccttggaggtcaggcgaccagacccggggtcctgggccttggaacagacatcccctctgtccatctgggcaggagcatgggacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactca

SEQ ID NO: 17132 - DNA, 588 bp, Homo sapiens
  ENST00000552550
attctctccgcgttgccctgcagattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcag

SEQ ID NO: 17133 - DNA, 516 bp, Homo sapiens
  ENST00000440827
aaaagttgcggggcatagacgagcggccccgggacgggcagctagcgcgaccctgagccggcgcccgtggtccggccatggacgacctcggctctgaggagtagattcagcagacaggactgatggacctctaccaagcagcgccgggcactaagttaagactggctatttgtagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctac

SEQ ID NO: 17134 - DNA, 579 bp, Homo sapiens
  ENST00000547746
atagacgagcggccccgggacgggcagctagcgcgaccctgagccggcgcccgtggtccggccatggacgacctcggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccag

SEQ ID NO: 17135 - DNA, 550 bp, Homo sapiens
  ENST00000540221
gttgggtgtttggagtccaagagacctgagatcagagtccagcattgtcacttcatccagccttggcagtgtgggatgtgactctgcctctgaaccgcagttataccatctgtgctggtggcgttgtgaggatggcaggtaacaaaggtgaagctcctggccccagtgggccttcaaggatggcagctgctcctgccccctactggggttgcactcattcgttgcctgctctggggagtcctatggggtttcttagctggccctgcccatggtggagaaagagggatccacccattgctgattgggcccagaggaaatgaggacactgcgtgaagccaagacagcagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagc

SEQ ID NO: 17136 - DNA, 547 bp, Homo sapiens
  ENST00000550205
aggtattctagctgacgacactgaagcacagagaggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaat

SEQ ID NO: 17137 - DNA, 584 bp, Homo sapiens
  ENST00000547772
gcgttccgttccgggccgaggctcgcggcggaaaagttgcggggcatagacgagcggccccgggacgggcagctagcgcgaccctgagccggcgcccgtggtccggccatggacgacctcggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagccta

SEQ ID NO: 17138 - DNA, 3835 bp, Homo sapiens
  ENST00000267257
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttcacctgtgct

SEQ ID NO: 17139 - DNA, 568 bp, Homo sapiens
  ENST00000505013
cagttgcttatagtctaggaagggatcacttgtgtaacatgggagcaaatgctgcctagcggaatattcgtgacttgggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaag

SEQ ID NO: 17140 - DNA, 3742 bp, Homo sapiens
  ENST00000636601
gggccccgcgagctccccggtggcgggtgcgcgccgccctcgcctcccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacagtaagaaggtggctatctgcaagccaggaagagaggcctcactagcaactgaaaatgctgtctccctgaccttggacttctcagcctccagacctgtgagaaataaatgtctgttatttaaggcaaaaaagagaaatcagtaactggaaaaagactaagagggttggaaatggagcacgagatgcactttatgtgcaggatgggccagcacttgttgagcatttcaacgcccaagacatgcagtgtgctttttacgcagaaccttgtttcatctcacagtaacctgtgacttaaagattatcatccccttttctttttttttttttttttttttttggagacaagctctcacccttgtcatccaggcaggagtacaatggcagtaatagctccctgcagcctcaagctcctgggctcaagcaatcctcccacctcagcctcccgagcagctgggattgcaggcacgagctaccacactcagctaattttcatatatttttttggagatggggtcttgctgtgttgctcaggatggtctcaaactcctgggctcaagcaatctgtctagcttggcctcccacagtgctgggattatagacatgagccaccccgcccagcctatcatccccatttttaagacagggaaagaaactgagaggagaggtcacttgccaaggcctctcagccacgaagtggcagaactgggaggcaaactagtctgactcaagcccttactcatagtcattatatcattatattaaacattcctcacaggggtctacagaaagcatgtgtgatggcttaccaatacatactaaatagttctctccggcatgtatagattttacattcatgacagcgtaaatcaaattaaaaacgcttccttggccctccacagccttccagataaaatccaggctccctaagggcctccctgagtacatggactgcagttgttgatggattttctgcatgtctggaagacagaaaaagcgtcttggatcatggtgtggggtgtgagattgacaggatctccgagaggacagtcgcttccagagcacttcagaagccagtgatttctcagtcctccactcttctccccttccctatctgtggtctccagtgtgatcacctagaaaaagagctttggaaccatatagaccaagctcaaatccagttctctaccacttcgcaggtgtggagcctcaagcaaggtacccaggctcctacaatccctaaaccagggatgatgactcccgcagagtgtatgtgaagctccagacacatggaccatctccacctggcaggagtcattatttctcacaaatgactctctccattgctctgagacaccaaaaccagttgaaaccagaatgacagccctgcccacatttttttttaatgtgaaagatgaaaggtcctcatttcttgttctgatagcttcctgccacacactgaagtctcctcaaggacacgtcttttactgcatgcagcttcacagtcagctcctcaagcagaagactgaaccgtgacttgtttttagaagctctccgggtagggaggacatatccatatgcaggacagaaccttgcttttcaaattcaagaaaaaacagtaactaatctatcgattcttctgtgattcagtctgccagggtgttctgtaaagaatccttttccatccctatcacacatttgtacgaaaggggagggagaggtggcagggtcccagtacaccggcaggcacttcggcgatgcccggggctccgctccctttctgttgatagttgtaggcgtcatttctggcagctgctgcagctcgatgcagggaaggaaggggccacccaccaatcacctctttctgatgccacatttttgacgttcatggaagaggcctgtctcagagctccctaagctgacaatctttgggcagccatctctattcttctcctggctggtgcactccttacaataataggcatcagagactcccatggcctccacagatctcacagtgtccctgttggacttgctgttcatttgagaggaagctgctgaccacagagttcagcaaaagaatgggagtatggaggctcaaagtgtggcccctggagaagctgaatgagaagtagccctggatatggtgtagactcccacaaaccagagatcctgccctcagtgcctcagctttaggaagctgctccctgccttgctcctgggcagacagaagccagagagaccacaggtcgaagcaggaccacgcaaggacgcgcacgcctctttcccacgccgcagagcgatagaacccgcaacaggaaaacggaaaggccgtgcgccggaagaacagcagcctgagctctttgaagactccttagtctaaagcctctgatggccaatggtctgcatctttcccatgtgctcctgaggtacaaaatggacatttcagctgcttttaatagaaactcactgtgtcactcataaaactcaggaagctgtcccaaatcctgggaggacatgaaaagaggctcactctgtagtcaagcacaggtatgcctaaggtgtgcaggtcccaagactctcccacttctctcttagtttggagtgggcattcttttaagaagtggaggaccctgtggtcactggcttccttagtggtgaatcatagggcaatcagagagcaggaatctgcaaaggggcgctgtcatgtgctgaattgtatctcctcaacatttatagattgaagccctagcctccagtatctcaggatgtgacagtatttggaggtggggcttttaaagaggtggttaagttaaaatgaagccattagagtggtccttaatccaatatgactggtctccttataagaagaaacttgtacacagaagagatacacaagggacatggaggcacagagaaaagcccatgtgaagaggcagcaaaagagtggccatgtgcaatccaagaagagaggcctcagaggaagccagccctgccaacactttgatcttgaactttcgggttccagactgtgagaaaataaatttttattgtttaagcc

SEQ ID NO: 17141 - DNA, 629 bp, Homo sapiens
  ENST00000514880
gcctcccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttctgaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagc

SEQ ID NO: 17142 - DNA, 3281 bp, Homo sapiens
  ENST00000286353
tcccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaatggtttgtacctataagtcactcgagttattttcaagtgagagccagtattttatttttcccccttcattcaaatgtcatgcagagaaccagtattttaaaattttattttaactgctttactaactgctgaaagttgtgttatctctcaagtattcaaagactaaatgtgttttctttccttcccactcacaatatatctgaattagaactgctaaacacagcttgaagacttaaaaataaaagtgactcggaa

SEQ ID NO: 17143 - DNA, 4654 bp, Homo sapiens
  ENST00000637751
cccctcgcgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacagtaagaaggtggctatctgcaagccaggaagagaggcctcactagcaactgaaaatgctgtctccctgaccttggacttctcagcctccagacctgtgagaaataaatgtctgttatttaaggcaaaaaagagaaatcagtaactggaaaaagactaagagggttggaaatggagcacgagatgcactttatgtgcaggatgggccagcacttgttgagcatttcaacgcccaagacatgcagtgtgctttttacgcagaaccttgtttcatctcacagtaacctgtgacttaaagattatcatccccttttctttttttttttttttttttttttggagacaagctctcacccttgtcatccaggcaggagtacaatggcagtaatagctccctgcagcctcaagctcctgggctcaagcaatcctcccacctcagcctcccgagcagctgggattgcaggcacgagctaccacactcagctaattttcatatatttttttggagatggggtcttgctgtgttgctcaggatggtctcaaactcctgggctcaagcaatctgtctagcttggcctcccacagtgctgggattatagacatgagccaccccgcccagcctatcatccccatttttaagacagggaaagaaactgagaggagaggtcacttgccaaggcctctcagccacgaagtggcagaactgggaggcaaactagtctgactcaagcccttactcatagtcattatatcattatattaaacattcctcacaggggtctacagaaagcatgtgtgatggcttaccaatacatactaaatagttctctccggcatgtatagattttacattcatgacagcgtaaatcaaattaaaaacgcttccttggccctccacagccttccagataaaatccaggctccctaagggcctccctgagtacatggactgcagttgttgatggattttctgcatgtctggaagacagaaaaagcgtcttggatcatggtgtggggtgtgagattgacaggatctccgagaggacagtcgcttccagagcacttcagaagccagtgatttctcagtcctccactcttctccccttccctatctgtggtctccagtgtgatcacctagaaaaagagctttggaaccatatagaccaagctcaaatccagttctctaccacttcgcaggtgtggagcctcaagcaaggtacccaggctcctacaatccctaaaccagggatgatgactcccgcagagtgtatgtgaagctccagacacatggaccatctccacctggcaggagtcattatttctcacaaatgactctctccattgctctgagacaccaaaaccagttgaaaccagaatgacagccctgcccacatttttttttaatgtgaaagatgaaaggtcctcatttcttgttctgatagcttcctgccacacactgaagtctcctcaaggacacgtcttttactgcatgcagcttcacagtcagctcctcaagcagaagactgaaccgtgacttgtttttagaagctctccgggtagggaggacatatccatatgcaggacagaaccttgcttttcaaattcaagaaaaaacagtaactaatctatcgattcttctgtgattcagtctgccagggtgttctgtaaagaatccttttccatccctatcacacatttgtacgaaaggggagggagaggtggcagggtcccagtacaccggcaggcacttcggcgatgcccggggctccgctccctttctgttgatagttgtaggcgtcatttctggcagctgctgcagctcgatgcagggaaggaaggggccacccaccaatcacctctttctgatgccacatttttgacgttcatggaagaggcctgtctcagagctccctaagctgacaatctttgggcagccatctctattcttctcctggctggtgcactccttacaataataggcatcagagactcccatggcctccacagatctcacagtgtccctgttggacttgctgttcatttgagaggaagctgctgaccacagagttcagcaaaagaatgggagtatggaggctcaaagtgtggcccctggagaagctgaatgagaagtagccctggatatggtgtagactcccacaaaccagagatcctgccctcagtgcctcagctttaggaagctgctccctgccttgctcctgggcagacagaagccagagagaccacaggtcgaagcaggaccacgcaaggacgcgcacgcctctttcccacgccgcagagcgatagaacccgcaacaggaaaacggaaaggccgtgcgccggaagaacagatggggtcttgctctgtcacccaggcggtggggcagtggcacaatcatagctcactacagccttgaactcctgggctcaagcaatcctcttgccccagcctgctgagtagctaggattacaggtgcatgccaccatgcctggttaattctttctatttttgagagatgggatctcactacattgcccacattgttctcaaactctggtcccaagttgctggaattacaggcttaaaccaccacacctgttttgtaacctgagcgcctccagacttctagccacatgtgcgatctcaatggattctggcgtagtctctctctcccctagggtcaggcaagatatcatcatttgtcatacatacatatacagcgtctatcagattctctcacaaaaagccctcatgaatagatatatactggggtggctgccataccctgaatccactttagacccctttaggaattcatctgagcaccttctaaatggaagtccacaagaggcataaaggtggcctcactacaccatggttgagtgagtggacctgctcccagtgtgatcaccgtatgtggtcccagggtccctccctctcaccaaagggcctttgggctaggaaagcaaatttctcttaatgtaactcttagaaattcataaatcaaagacaagtttccttctcttaatgtaactcttagaaatccataaacctgttaccagttgaacatcctaatcccaaaatctgaaacccaaaatgctccaaaatttgaaactttttgagtgcccatatgatgctcaaagaaaatgcttactggacattttggattttggattttcagattaaggatgctgaactggtaagtataatgcaaatattcagaaatctgaaaaagtccaaaatacccctggtcccaagcattttggataagtgatacacaagctataataaaattatttttatttttatttctttataaacagggtctcgctctgtcacccaggctggaatgcagtggtgtaatcagagctcactgtagcctcaaccttctaggctcaagtgatcctcctgcctcagccttctgagtgtctgggcatacaggagagtgccaccacacccagctcctgtgataatattagagaattaaataattcaattaacaagattagtagatacttgagcaaaatttgggctttgccaacatggaagacagggcatgactattaggtaggcacaaaaaaatgcctgctacaattccctgtatatatttaaattatttccacaataaaatatattgcctacatgattaaagaaggaaagaaataaaggtaatgaatatgaggggaaaatggaaatataaaactaagaagtgatgtcatattttgaggtatttgagaagacatgctggtaaaataaacagactaatttgctaaaagccaattcaatgattgaccaattcaccacatttacttgctccttttacttatttacaaggtttttggcaattcatactggatggtattcttttaacagtttttgaacatttctgcaaaatatttgttggccagtattcctttatatctgtataacagcattttaaggaatattcaatctgtctcagcccagttagttagaagacagggtatatgtagaagaaaaatattcacaagataaataa

SEQ ID NO: 17144 - DNA, 2066 bp, Homo sapiens
  ENST00000502783
gggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaaga

SEQ ID NO: 17145 - DNA, 3160 bp, Homo sapiens
  ENST00000393010
ccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactata

SEQ ID NO: 17146 - DNA, 684 bp, Homo sapiens
  ENST00000511968
cgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgtgagtaagagaaagggaggagagggagaaagagacatactactatctagaggtgggtgggagaaaggataggagaatgttcaaggtcctgaaaattcatagggggagattttggccccagaacctgtccctggacaaggttcctggttggtggataaggaagtgtgcccacattccagtgtaggggttaccagttaggagcaaagtcactgagataggaaaaatgaccccatgggaatctgaaatccatttgctgggcccatcattctggttttgagaaggccttgaaagccagctgagacttgggcttagcacggcaggagagcactgagctgtttgaagtttttgaatgaggtgtgtgcccttttggaaataatggcttgagcaagattggtctggggtttggcctgggaagccactttaccatggcttaatttataggccctgagctgtagccccagtccc

SEQ ID NO: 17147 - DNA, 478 bp, Homo sapiens
  ENST00000514680
agcgacggagctggggccggcctgggaccatgggcgtgagtgcaatctacggatcagtctctgatggtgggtcgttaacctcagtggggactccaagatttccatgaagaaaatcagttgtcttcattcaagaattggggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattc

SEQ ID NO: 17148 - DNA, 797 bp, Homo sapiens
  ENST00000513528
gacggagctggggccggcctgggaccatgggcgccctctcccgcacggcccccgcactcccgccgctggattccagccgagattcaagctcccgggatcccccttcccgggcggtcctgagccggctagtctccagtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgacca

SEQ ID NO: 17149 - DNA, 479 bp, Homo sapiens
  ENST00000505502
ggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgccctgagctgtagccccagtcccctttgacatcacccattttccaatggaggaagcttccagggagacagggtaccacttggagagcccccatggccacttcagattgcagccattgccacttcatctcacctgaggtgctgaggggagagtctagtttacagggcatccttttgtcacctgctcgccacccttatgcccctgggtgtgaccagcttcctcagaaagagctgtaatcaatagcatattgattaaaaagcatattaagatgaaaa

SEQ ID NO: 17150 - DNA, 582 bp, Homo sapiens
  ENST00000513007
gagtgcggcgcgggcctgggccggggcggttgccgttggggccgagcagcgcagaggttctaggcgggacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtggtaagatattcagtagtttaattgtttataaattttcattaaaaattttccatcctttggttggagaggtaggatgttacagtcaaccctgattttattttgagaggctgacaggttctgagacatgaatgtgtgttacttgtgtttgtggcatttctcttgcatgagctggtttccacgtcactgaattggcctgtgtgttttgcttatataactcttctgaaagtaccttctgttttaggaaagccaattttcagccatacttttttaaggaaaattttgcag

SEQ ID NO: 17151 - DNA, 2390 bp, Homo sapiens
  ENST00000637579
gacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacagttggacttgctgttcatttgagaggaagctgctgaccacagagttcagcaaaagaatgggagtatggaggctcaaagtgtggcccctggagaagctgaatgagaagtagccctggatatggtgtagactcccacaaaccagagatcctgccctcagtgcctcagctttaggaagctgctccctgccttgctcctgggcagacagaagccagagagaccacaggtcgaagcaggaccacgcaaggacgcgcacgcctctttcccacgccgcagagcgatagaacccgcaacaggaaaacggaaaggccgtgcgccggaagaacaggatgcagggtgaagaaataatcagcctctgttcatcttattagagaaataaatacctgtgtatatgaagcaagcaaggccactgagtctttggggaaacagagcagggaggtgcccagaggcattttctgcagagaaggaagaaaagaataaacaagtcttctgccaaaaatgcctggaacttaaagcgatttcctcagcccaagatcaggctgtgtgcagacactgacagtgaacctgatcagttgctgctgctcccttgattaaaagcatgtagctttctctcttgtgaaattcacctctataaattccacctgcctagggattcaaactacatggaacaagtgcaattcctcagagtggcaactggcagagctcccaggaacaaggtagaactacacaatgtcccaggcatcagaggcatagattgcctgagtcagggagagtggtctctgtgacctgacaccccacccacagtgggaaggaaagctgtgggtgtgttatcaaggaggcctccacaaggggctggaaattcctggttttgtcttcctcttggaatgagacatttactctaagagaatcatggaaaagtacaaaccacagaatcataaaccacagagggagaagctacctcgtaggtcattcttatgctgggcccagataccccgataagcagatgttctcttctcaccacccctcctcgcctttgcttgcccacagccattgccaggactcttcctcaggcccagaaaggcagctgattcctggtaggagggcgctaagagtagaaagtaactaccattgtcaggtccagatctgttcccaatcccttctcactcctcctgcactctaaaaccacaccacagttccaactctttctgagtctggaatctttgagagtgccgtcatgtccttcttcctgtagccttcttgtccaccccagatggactgaccctcccacctacatccatgaggccagaaggcaacaaagacaagcgtggactctggctcccgccgaggtactctgtaccccgtggctctcggattttgcatctaccacatgccacaggcttgcgtccatccgacctccctagtttctcatccccacttgaacctgatgactgattcgccctcctggctacgctgagtaagccacccacttgccaaacctcagacctggtgttgacgcagtaagaaggcatgaggcccatgttgccagaacattcctaattgtttcattgtttccttgtaggatgtggtttcaagtcccatctttgtctcttttctcctggccaggttgcccttggtcaatattccttcattcactccagccactcagcaccgtgattaagaaaacaggatgtgagattagatgatccaggctctgccatgaactaactagctgtgaggctttagagaagtgtcttaacctctctgagcatccatttctttctctatagcattaggaatattaatagtacctacctcacagcttttttgttgtgataa

SEQ ID NO: 17152 - DNA, 569 bp, Homo sapiens
  ENST00000512457
tttctgttgcagtttgaatgatggaaagaagggcaggtggctcgaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacagg

SEQ ID NO: 17153 - DNA, 1773 bp, Homo sapiens
  ENST00000504264
aaaattttgcagggtaaattagcctgtctgggtctgagctctttattcttggatacgttggagatcggaaagatattaagatatggacgttcttactgctcttcttttagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtt

SEQ ID NO: 17154 - DNA, 4158 bp, Homo sapiens
  ENST00000508812
ggaaagccagtccaagttccaaaactgaggaacttggatccgatgttcaagggcagggcgcatccagcatgggagaaagatgtaggttgggaggctaggccagcctgtctattcatattttttctgcctgcttatattccagctgcattggcagcttattagattgtgcccacccagattgagggtgggtctgcctttcccagcccactgactcaaatgtaaatctcctttggcagcacactcatagacacaccaaggagcaatactttgtgttcttcaacccaatcaagtggacacccagtattaaccatcacatctggtaacttcccaatatttcctttatatccatgtcttcactgcatcgtttccatacctgcaccccccaaccagcaaccagtgagtgcagggggccccgtgcctgagaaggctattttctccttatggtccatgtgctttctccccaccttttcttatttaatgtctgactgtcccccgcaactggattgtaaaccccgtgagggcagagaccttgtccattttattctctgaagaatccccagcatgtgctccatacatgttggatggccagatggacaaatgcataaataccgagcttagtgggtgagcaggtccgggcttacaggcttcaggaccttaggtaactcccttgacctgcctctgcctaaggtctactgtctggctgatggttactcttcctaggttgagatccaaagctgggaaaagcagagagaggatcagtttggcttgcatcctagctatagctatgggaatgtttactagtaatacatacagagtcatccactgtgcattcgggagatggggtggggaagggtggtggggagggagcctgcgtgggatagcatctggttgttttactcatgattctaagaaatttgttggttgcttttgagagggagggtcccaaggagatgctttagaggtcatgttctctgccatttctttgaaattgagaccttgtcggcatctttacacatgagggttatagatgtgtggacaggatgaaagtgatcgtagatgagatgagcagagaacaccgccataaaagagaggcttatttccaaaggtagcttacggaaatttgccctcctacttggtaatcacaccacagagaaattgcatgcccgttggtacagagttaatcatcagtaaaagatatctcgtatcctgttattcgtgttggtcctggtggcacagtggccccaggacactcatttagattcatgggttttcccacctacataatgaaactcgttatccttccatctatttatctgcccactattctttctgatgcccccacagcctctttctcttgccctgtgacatctgagctgctgtcatctgcctgaggtcagcagagtttctaattgttccacaggacagctagaggcacggggggcctgggcaaagcctgctgggaggagcagtgtcctggagcagtgtctgcccccagcccctgggtctgtccctcagctccctttatctaggtgatcggggcaagcctcaagagctgatgtggtgagtagcacagcaccagggcagaggcggcctgcagcccggggtctgctcctccaggccccttcccagccttcctcctggagcccggcctgcacatcgaccctggtgaggccaacctgaccaggccttacgggacccaaggcgtatcctgagccagcttgctgacccccatctgccatgtttggctgtgtttcacggcctcccctctgctcctctcctcttcccctccacacagccagcttcatcagtttttcaggcccagctaggtgtctcctctgggaagcctgtttggatgcccctcaccccagactggttcggcaaccctcagtgctccacatgaggagtcaatgagatatttcatcaaaagcatggagcacagcgtctgccccagttcagcagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactga

SEQ ID NO: 17155 - DNA, 289 bp, Homo sapiens
  ENST00000514263
aaaaggatccggagcctctttcgaaagccccttgaactccttgcctctttacccaaatcacccattgtgtgagatgggagagctcacacagacaggagcataatcaacatactgttctacacttggcttttttccagtattctatctgggtatcaggagattgttccatatcatacagagaatgcatgtgtgttgacgagtctgtaaagcccccaggatcaggcagaacgtacccagcaggagttgtgcagcatttgcagaacggtcagctgctgagggatatctatct

SEQ ID NO: 17156 - DNA, 2152 bp, Homo sapiens
  ENST00000483742
ttgtagagatggggtttcatcatgttggccaggctggtcttgaactcctgacctcaagtaatccacccgcctcggcctcccaaagtgctgggtttacaggcgtgagccaccgcgccctgcttgaatcctgatatcttagcattggagagagattttccatgttattagtcttcaaaaatattttaaatgtttgtataacattccatcctatgagcatgtcacaacttatttaatcaattccatgtggctggacactaaggttaatttccggtttgttaaatattactgtgatgagcaaccttttaatgtctacgtccacatctgatgatttccttaagataattatcagaagggtgatatttctgagttaaaaagtatgagttcttaaggctcttgatacagattgccaaactgctttccagaaagtttctcccagtttacactcccacaacagcttcccagagttggcattaaacactgaaagaagtgtctcctgtgaggcttcactagaaagctggctgtcccatgggcaggagggagctgtgagatgttgtgagcatggtcccgcatgctcagaacgaggcctggaagaaccctctggctgcaggatggagacagtgctggagggggcaggtgggggaccactgtgggggctgacaccataatgcagggagagttgcctgagagtcgcacaagggactagagagtcgcacgagggattagagattttgtggggagcgctggtttctggttggaacggttaggttttgagactggcctgtggagcgctttgagccgtggtgggggcgctgagggtcagctgaagggttatctttttttttttttttgagatggagtcttgctctgttgcccaggctggagtgcaatggcatgatctcggttcactgcaacctccgcctcccgggttcaagtgattcttccacctcagcctcccgaggagctgggattacaggcacacgacaccatgcccggctactttttgtatttttgtagagactgggtttcaccatgttggccaggttggtcttgaactcctgacctcctcagatgatccgcccacctcggcctcccaaagtgctgggattacaggcgtgagccaccatgcctggcccagttgaagggttgtacctgttagctgctcttgctgccccagggcaaggccggatatggacttgggctactggaggagaaaagccattttggagcaaacaaactggttaagagacagcagtggcgtgtgggagaaaagagcttgtttgggggccttggctctaacacttagctttctgtatcctccgggcctcagtttcttcattcacaaaggagggatgaaaagctgagcagagaaggggagttgcagggaggccctgcaggggcgatgtggcagccctggggagcagcaggctggacctgggttttgaccctggggcatgggacttctcagcttttctctggaagaggagccaggaacccctttccggggagctgaccacagctctgtcctggcaggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 17157 - DNA, 2611 bp, Homo sapiens
  ENST00000377432
actccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 17158 - DNA, 3198 bp, Homo sapiens
  ENST00000164139
ccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 17159 - DNA, 470 bp, Homo sapiens
  ENST00000462303
ccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttggga

SEQ ID NO: 17160 - DNA, 328 bp, Homo sapiens
  ENST00000460413
ctccaaatggcatagggcagtgaccatagcatggaatgtggtttggagcccagactgacccctccccctaccccaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggcc

SEQ ID NO: 17161 - DNA, 2865 bp, Homo sapiens
  ENST00000483923
tgtcaaccagcactttttaagatgaactgtaaccaactagcttctcacatgcttctcatatggtaagagttaattttagctcatgaaacttttggttctgtgaaacacctgctgaacagactcctgggaagggggtctgtgggagtcgacatttatacaaccttccaggtgattctgagcttatcagagctggagaggcacttgctacccaggggcttggtgtggaacgtgagatgccaaagccaaattcaggcctctcagctcaaggcaccctgaagcacagctagtcactccagcacatgttgaagctgtgcatgtttacttcatgttgaactgttcatgttttatttttggaacactggggattggcaaaaaaaaaaaaaacccatgtgaataaagccttctagggcaccactgtgccgattgtgaaccacacgtggacaaaacaagccgcgcttgatagcaactacctacatgaccagcactcccctggatgctgatgctgccatgcgagacgggacgttggcgcagcagcatgccagccacccattgcttctcctgcttgccaactcaaccgtgctgctccctcagacaccatcacttgcgcctcccaagcaatggaagccctggcgatgctctcatgagcccctcactccagcagagcccctgaccaagccaggggagcaggacttttccagccaaggacacaacggactggtggctgtgagtacctccccacttgatcccacttcactggccctgggcgtgtggctctcagcagcctgggaaggagtgtgaagaagcaggtgggataagggccttgagagagaaggaaaaggcagcctagtcgatgctctctgctctccagtgctgactgggggctgggtcgaatgctcatctgcagccagctgtggacatcacaggctcctttcctccccttcccctaatggggaaaggtggtttccccatggcctgtgagggagtcagggagcttccagaaacaagctgacaaggtggggaagcatgtaaccaacacagcatgagagcaggcagcgtacctgcagagactgggggtgaacaccgccgtcttcgagaggcgccatgtgatcgggggtgcagctgtcactgaggagatcatcccagggtttaagttctcccgcgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatggtaagaggcacaccacattgcagcactgtctcctttgacccatctgagtgagaaacctccaggctgggggcagctgaactcagtcatcatctccattcccggacctccagcctgtgtccccctgcagcctggtcagaagtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagatta

SEQ ID NO: 17162 - DNA, 2028 bp, Homo sapiens
  ENST00000370575
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgcgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacaggcctgtgattgagctctgcatcccttcctcgctggaccccaccctggctccccctggctgccatgtagtctccctcttcactcagtacatgccctatacgctggctggaggcaaggcctgggacgagcaggagagagacgcttatgcagacagagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagatta

SEQ ID NO: 17163 - DNA, 410 bp, Homo sapiens
  ENST00000464808
cctcttcactcagtacatgccctatacgctggctggaggcaaggcctgggacgagcaggagagagacgcttatgcagacagagcacagctgactgcacgaaccaaaggagacgcatgagccagagagacaaggaaggctttcaaaggaagggatggtcaagctgggtttccaaggatgactaggagctggccaggcagcaaagggcattccaagcaagagaaacagcttgatcaggccaggcgtgggggctcatgcctgtaattccagcacttcgggaggccgaggcaggcggatcacccgagtgtttgattgcatcgaggtctatgcccctggcttcaaggactctgtggttggcagagacatcctcacaccaccagatttggagagaatcttcgggcttcctggaggg

SEQ ID NO: 17164 - DNA, 501 bp, Homo sapiens
  ENST00000494941
agccaggggaggtctgaagcctgagtatgatgcggtggtgataggagcaggcaggcacctgggattccggtgctggctctgctgtgtggcctggggcaaatgcttgccttctctgggcttggatcttcccatggagaatgacaggaagactagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaa

SEQ ID NO: 17165 - DNA, 279 bp, Homo sapiens
  ENST00000462874
gcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcagagggccccaaatgcatgattgccaactgggtctatacagagataatgacgggaccgaaagcagacggcactcaacatgcagctttgagggcatgccttcattttcatatgtactagagcagttgcgagc

SEQ ID NO: 17166 - DNA, 584 bp, Homo sapiens
  ENST00000511609
ctgccattttttgatgggggttggtgagggcgtctgacctgaaggaggaggccagatgcagctatttataaagtttttagggaatagagatctcaagagaagattgcatgtccttgctgtccccctggccgccagtggtcactgagccatcttctccccatttcccaggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcc

SEQ ID NO: 17167 - DNA, 781 bp, Homo sapiens
  ENST00000514300
gagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggatttgagtaacaacagataccatatggccagcaaagcctaagtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaacc

SEQ ID NO: 17168 - DNA, 1068 bp, Homo sapiens
  ENST00000505710
gatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttgtttaggtatcagttc

SEQ ID NO: 17169 - DNA, 803 bp, Homo sapiens
  ENST00000501943
gctctctgccattttttgatgggggttggtgagggcgtctgacctgaaggaggaggccagatgcagctatttataaagtttttagggaatagagatctcaagagaagattgcatgtccttgctgtccccctggccgccagtggtcactgagccatcttctccccatttcccaggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttga

SEQ ID NO: 17170 - DNA, 601 bp, Homo sapiens
  ENST00000508623
cggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgaactttccatgactggatcacagggaaaaaccgaccgagctcaggaagcctaatccaggtggtaaccacagaaggaaggacggaactcaccccagcatatttttaggcctcatctcagtgcctatgaggggc

SEQ ID NO: 17171 - DNA, 1648 bp, Homo sapiens
  ENST00000281243
acagtccctccgggtggcggggcgccccgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaa

SEQ ID NO: 17172 - DNA, 1278 bp, Homo sapiens
  ENST00000428702
ggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttcttt

SEQ ID NO: 17173 - DNA, 1374 bp, Homo sapiens
  ENST00000507439
gctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaa

SEQ ID NO: 17174 - DNA, 1188 bp, Homo sapiens
  ENST00000513615
ttcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggaactgactcagctgcaggaggacagcttcaattccctatgagttcatctcggacccaaccaatcagagctcttgactcactggcttccccctacccaccaagttgtccttaaaaactttgatccccgaatgcttggggaaaccaatctgagtaataataaaactcaagtcacctgcacagctggctctgtgtgaattactctctctattgcaattcccctgtcttgataaaatggctctatctaggcagctggcaaggtgaatccattgggtggttacaatacctcccttagtagactaaagaacaacttggataaaaccagcaagaaatggattatatcgagggaaattgtcatgcccatccaagaccatgataaggaatgaggaagtaacataatggaaggattctgtctcttctcattgggactgactctaagcacctctgattagatgtcattctatgtctgggatgatctcaggactatggtattgtcctcttgtgctatcaattttaactcacaaatggatgtcgatgtcatttattctcttattctacagaccttcattggctacat

SEQ ID NO: 17175 - DNA, 6085 bp, Homo sapiens
  ENST00000361758
gggcggagcgaccctcggaaggggcgtggcgaccgggctcgacgcgcgcacgcgctctggagccccacggctacgtgtcgggccacgtgatgcccaccccgaaagtcccccgtgaagcaacaggacgttaaaaaaaaatttctcttctgcggggtggataagaggttctgaaaaaactatagtaacgggaggcgaggcggaggcagcgctggcgcgtcccgctggaattcctctcgcctgccgcgccagccccgaccgcgcccgcagccccacccgccccgtgccgtggaaagccccgcgccccccccgcggccgtcggccccgcagcccacacccacccgccccgggcgccccgcacggcggcgacccagtccttgcgcccaggcccgccgagcgccgcagtccgtcacactcccgttgcccccgtcgcccgccccgccggggaggcagggaggagggggcgcggcgccggcggctgccccggtcgcggggcggcgggcagcaggcagcgggagcgcgccggccgggacccgctaacggccgccctgcgcggccccgcccgccgcccgcccccggccctccccgcgccgctgcccctccccccgccgccgccgctgctgccgccgccgctggcagcgccgcctgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaa

SEQ ID NO: 17176 - DNA, 5685 bp, Homo sapiens
  ENST00000453779
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 17177 - DNA, 6964 bp, Homo sapiens
  ENST00000275262
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 17178 - DNA, 7911 bp, Homo sapiens
  ENST00000392127
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 17179 - DNA, 9463 bp, Homo sapiens
  ENST00000361752
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactga

SEQ ID NO: 17180 - DNA, 1063 bp, Homo sapiens
  ENST00000361195
ggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatg

SEQ ID NO: 17181 - DNA, 954 bp, Homo sapiens
  ENST00000424802
atggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 17182 - DNA, 846 bp, Homo sapiens
  ENST00000545607
agattacctgatgcagctgatgaacgacaagaagctcatgagcagcctgcccaacttctgcgggatcttcaaccacctcgagcggctgctggacgaagtttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcac

SEQ ID NO: 17183 - DNA, 495 bp, Homo sapiens
  ENST00000544436
agtacctgaagtattaatttctagtagctgtgggtttctgtggacgcctagagaaaaaaaagaccacaaaaaaagtctgtttcgaaaatcgactggccaggagtttgtttgtttttttttcctgcttagaggcaccaccggaggactgtgtaaaggaaactgaaaactacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatc

SEQ ID NO: 17184 - DNA, 583 bp, Homo sapiens
  ENST00000537041
aaaaattagccgggcatggtagagtgtgcctacagtgccagctacttgggaggctgaagcagaagaatcgcttgaacctgaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccag

SEQ ID NO: 17185 - DNA, 551 bp, Homo sapiens
  ENST00000537124
aacctggtaggcggcggttgcagggagaggagattgcgccactgcactccagcctgggtgacagagcgagattccatctcaaaaacaaataaaatttggaaccttttttgtaaactcttcaatgtcatagttttacagggtctcaaacttactttgcagattatatcagagaattgtgttttagagctgcaggggacctgagagttgggagtatatgttcatttcataggtgcaaagacaagtgggcagcagagctagagcaagacactcacttctgccctctgttccattttgtggcgtgcctctccacaaggggaactggagggaaaaacctggaatatttccatatgctaaaaatctgctgctgttgcctcaagttgtgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatcct

SEQ ID NO: 17186 - DNA, 457 bp, Homo sapiens
  ENST00000545346
agttcatctttggcagtagcatgaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagatttgtgacttcttgccacggtgaactactattaccgactggtgtgttggagcatggcatttgtcttgatcggtgattctcaaaacacagtccttggaccatagtatctacgctttctgggaactgtaaatgttcaagcccctttccatacttattgaatcagaaactctgggtttaattttgttgggagaatccttggacctagaggacttacagccaaacaacttgaagcagaaaccggatgtaaaatcatggtccgaggcaaaggctcaatgagggataaaaaaaaggag

SEQ ID NO: 17187 - DNA, 597 bp, Homo sapiens
  ENST00000544823
ttcctctggactagcaagaatattttttttgtctaacacatttaaaatttttacttttaacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctc

SEQ ID NO: 17188 - DNA, 1106 bp, Homo sapiens
  ENST00000537883
agagaaaaggagtgcagaattgcctgatgctgtgggacctattgttcagttacaagagaaactttatgtgcctgtaaaagaatacccagatgaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagactt

SEQ ID NO: 17189 - DNA, 588 bp, Homo sapiens
  ENST00000540719
catgtactctgtaaattttttaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatattt

SEQ ID NO: 17190 - DNA, 613 bp, Homo sapiens
  ENST00000544361
attgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagtcacaatggcaacagtacagaaaattctatcaaacctcagaatatagtagaaataattaagctgttgaatgagtcttaaaaattatactactgttaagtggacc

SEQ ID NO: 17191 - DNA, 1097 bp, Homo sapiens
  ENST00000541696
catgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatg

SEQ ID NO: 17192 - DNA, 6085 bp, Homo sapiens; identical to SEQ ID NO: 17175
  ENST00000361758

SEQ ID NO: 17193 - DNA, 5685 bp, Homo sapiens; identical to SEQ ID NO: 17176
  ENST00000453779

SEQ ID NO: 17194 - DNA, 6964 bp, Homo sapiens; identical to SEQ ID NO: 17177
  ENST00000275262

SEQ ID NO: 17195 - DNA, 7911 bp, Homo sapiens; identical to SEQ ID NO: 17178
  ENST00000392127

SEQ ID NO: 17196 - DNA, 9463 bp, Homo sapiens; identical to SEQ ID NO: 17179
  ENST00000361752

SEQ ID NO: 17197 - DNA, 1063 bp, Homo sapiens; identical to SEQ ID NO: 17180
  ENST00000361195

SEQ ID NO: 17198 - DNA, 954 bp, Homo sapiens; identical to SEQ ID NO: 17181
  ENST00000424802

SEQ ID NO: 17199 - DNA, 846 bp, Homo sapiens; identical to SEQ ID NO: 17182
  ENST00000545607

SEQ ID NO: 17200 - DNA, 495 bp, Homo sapiens; identical to SEQ ID NO: 17183
  ENST00000544436

SEQ ID NO: 17201 - DNA, 583 bp, Homo sapiens; identical to SEQ ID NO: 17184
  ENST00000537041

SEQ ID NO: 17202 - DNA, 551 bp, Homo sapiens; identical to SEQ ID NO: 17185
  ENST00000537124

SEQ ID NO: 17203 - DNA, 457 bp, Homo sapiens; identical to SEQ ID NO: 17186
  ENST00000545346

SEQ ID NO: 17204 - DNA, 597 bp, Homo sapiens; identical to SEQ ID NO: 17187
  ENST00000544823

SEQ ID NO: 17205 - DNA, 1106 bp, Homo sapiens; identical to SEQ ID NO: 17188
  ENST00000537883

SEQ ID NO: 17206 - DNA, 588 bp, Homo sapiens; identical to SEQ ID NO: 17189
  ENST00000540719

SEQ ID NO: 17207 - DNA, 613 bp, Homo sapiens; identical to SEQ ID NO: 17190
  ENST00000544361

SEQ ID NO: 17208 - DNA, 1097 bp, Homo sapiens; identical to SEQ ID NO: 17191
  ENST00000541696

SEQ ID NO: 17209 - DNA, 913 bp, Homo sapiens
  ENST00000219771
gactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttca

SEQ ID NO: 17210 - DNA, 2343 bp, Homo sapiens
  ENST00000395384
ggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaa

SEQ ID NO: 17211 - DNA, 579 bp, Homo sapiens
  ENST00000562473
acagctgcaagtcaccatggacgctgaaggcctggcgctgctgctgccgcccgtcaccctggcagccctggtggacagctggctccgagaggactgcccagggctcaactacgcagccttggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttg

SEQ ID NO: 17212 - DNA, 2199 bp, Homo sapiens
  ENST00000564967
tttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaac

SEQ ID NO: 17213 - DNA, 6253 bp, Homo sapiens
  ENST00000287263
ctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaagatttgtgtctgtagtttggtatgggtgcaataaaaatttattttgtcttcctggaaaacctctcttggtgggggtggggggatgaccagtgtttctcatcccatgagggtctctcactgggatttctgttgctgccatcttgcctggttcccaggagtcccaaggccctttttctcaaagaggacggacatgtctggtcccttcggatgcacccttcatcttggcctgagggaccatggcactggccagagaaactgagttggaacgtgctgcccccttttcctttgcagccggtacccttggctgagcatttggacagggtctttcctc

SEQ ID NO: 17214 - DNA, 7811 bp, Homo sapiens
  ENST00000330843
tgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggtgaccacacctgggccagcgacgtgtggtgcgccagcctccccagcggatcacctcctcctcccctcccaggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaa

SEQ ID NO: 17215 - DNA, 1866 bp, Homo sapiens
  ENST00000522727
tgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagt

SEQ ID NO: 17216 - DNA, 2329 bp, Homo sapiens
  ENST00000523182
gacgttctcccctggtgaatgacttgtttttgtgtattttctttgtctctcgtgatgcatctgcactgacctgcagattttattttgtcctttttgcagactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggtgaccacacctgggccagcgacgtgtggtgcgccagcctccccagcggatcacctcctcctcccctcccaggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaa

SEQ ID NO: 17217 - DNA, 3078 bp, Homo sapiens
  ENST00000522774
gacgttctcccctggtgaatgacttgtttttgtgtattttctttgtctctcgtgatgcatctgcactgacctgcagattttattttgtcctttttgcagactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggtgaccacacctgggccagcgacgtgtggtgcgccagcctccccagcggatcacctcctcctcccctcccaggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacaggtgagagatgggggagattgtctatgtaaatgtgagcaatgtccccctttgcttcctacctgcagaggttacggctttctaaccacacagacgtctgatgtgacaacccacctgtcactgtcctgctggtagggctgccccttgtggtggtaatacctcaagacactgctgcgtttatagcaagaacataatagtagtctgtaaatatagcttaggaattgttctgcacggtcagatttggagctcgcacattgcagaaacgcaatgccaccagtatcttaactgtctcagaactaactggcattgagtggtagtagtatctagcagtgtcaaaaacttcttcaagcactccccaacgtgaagcttgtatgtttgttttgagctgtctttactgtggagggacagaagcctctgcagagttttacagtgaatgcctaggctctagttgacttaaaaaaataagagactgcctttaatgttctgatgtttgtaacaagaccaagggtcccgtgaagatatcaggacatctggacaaggacatgctttcctggcttgcatgtggcagccctgtcctgactgcttttgtttccacaggaactgagacattggagtgctttggcccagagatgagggcagcatgtgacccacctgccccttgtctggcttactggctgccgtctttgcagtgggcagttgctcagttttgccatgaccggagggtctaaagatccttttccccttctctttagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaa

SEQ ID NO: 17218 - DNA, 1959 bp, Homo sapiens
  ENST00000524118
acactggatcctatctttgtctagcgcgtgtcttctcaaaaataaaagtgcaaaataaaaaacaaaacaaaagaaataaaagtgcaaattctgctctcagccgggtgcagtggctcacgcctgtaatcccaacattttgggaggctgaggcgggcggatcatctgaggtcaggagttcgagtccagcctggctaccatggtgaaaccccatctctactaaaaatacaaaaattagctggacatggtcacgcgctcctgtaatctcagctactcaggaggctgaggcaggagaatcacttgaacccaggaggcagaggctgcagtgagccgagatggtggcattgcactccagcctgggtgacagagcaagactctgtgtcaaaaaaaaaaaaaaaaaaaaaaaaaaaaattctgctctcatctaccacttcccgaagagaaagcatgagaatgcatgcattgaagaggctgctggtagcagagaggagaggccagttcatggggattgtgaacattgttgcagttgcttccattcaaaggtaactcctcagcctttctcctttcaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaaggtatgtcctctgagaagctggtgtgttcgttag

SEQ ID NO: 17219 - DNA, 3391 bp, Homo sapiens
  ENST00000267512
gggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctggtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaaccacc

SEQ ID NO: 17220 - DNA, 3515 bp, Homo sapiens
  ENST00000533601
cgcgcgctccccgccccctctctccggggcggcggcggcggcgcaggggaaggggcgggcaggggccgccgccggtttctcctcccaccgcctcgcgccagcccagccgagccgagccgagccgagcgggcgccgcgccgggctcccgccgcagccgcgcttcccggcacccagcgagcgagtgggcaggcgggcgggcgaggcagccgcgggggccgggcccggcgtcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacca

SEQ ID NO: 17221 - DNA, 2209 bp, Homo sapiens
  ENST00000585059
gcccccgtccccagctggggaggaattgccagcccctccggctggaggcggtggcgccggaggccggagtccgggataaatctcggggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctgggtgagtaagacatggggaagaaaccgaagctgccatgccctcactctctataccctgccaggcctccacggctgtgtctttcccggaaatgaattagttccaagtcttccctgtgagcagcttctttcctgaaatcttgggaccaggtggagttgcaagattgggatctagtcctggctctgcacaatagctgtggagccttgggaagccatttgaatcctctgggtccccagttcctgtagaatgagggctggacttacatccaatgtcctttccagctctgataccagtggtctaacccaaggaagcaccagtcttagccagagtgtcttctaccctaagctctccccgtgatacccttgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaa

SEQ ID NO: 17222 - DNA, 683 bp, Homo sapiens
  ENST00000426039
ctgggcgacagaggaagactccgtcaagaaaaaagagaaaaggcatcaggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatca

SEQ ID NO: 17223 - DNA, 533 bp, Homo sapiens
  ENST00000554593
acactctcggggactcatggagacgggtgttcgaatccagatcctgctcaaggccttcctacctcgggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggagga

SEQ ID NO: 17224 - DNA, 560 bp, Homo sapiens
  ENST00000555256
agcagcttctttcctgaaatcttgggaccaggtggagttgcaagattgggatctagtcctggctctgcacaatagctgtggagccttgggaagccatttgaatcctctgggtccccagttcctgtagaatgagggctggacttacatccaatgtcctttccagctctgataccagtggtctaacccaaggaagcaccagtcttagccagagtgtcttctaccctaagctctccccgtgatacccttgaggtcagccatggcacttgggggagcctggcacctgcatccagtcggcccaccctgtccctagggctctggaattggtggtgggctggaggcagtgcagactctgtagggaaaattgggggggcaggcagcactcactggctgttctgcccatcctttgtccctagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaac

SEQ ID NO: 17225 - DNA, 3459 bp, Homo sapiens
  ENST00000396307
gatgcctgttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaa

SEQ ID NO: 17226 - DNA, 1057 bp, Homo sapiens
  ENST00000564609
agacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaa

SEQ ID NO: 17227 - DNA, 1013 bp, Homo sapiens
  ENST00000569493
cacaggaagagaagtgggtttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaa

SEQ ID NO: 17228 - DNA, 663 bp, Homo sapiens
  ENST00000566877
actctgcatactgaataataggtgaaataaggaaagactttgagaagcaataagaaatatatctgatttgaccttgtccattaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatgga

SEQ ID NO: 17229 - DNA, 701 bp, Homo sapiens
  ENST00000567380
gagaaaagcaaaggaggtgagtacgggacatgctggatttgagatgccagcaagatatctgggtggactcccttgtaggcagttttacttatgaaattggaggccagctgcaaggtctgacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggagga

SEQ ID NO: 17230 - DNA, 809 bp, Homo sapiens
  ENST00000565972
gagaagtgggtttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttgaggctctgcccttatccacgggctagccatacctgaaacgtgaggttgcagatctgcactgaagcactctgaggaaacacactgcagtggcttttggggctcagcattcaggagttttcagcataaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgat

SEQ ID NO: 17231 - DNA, 702 bp, Homo sapiens
  ENST00000563262
cccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatacagtctcgctgtgatgcccaggctggagtgcaatggcgtgattttggctcactgcaacctctcccacccaggttcaagtgattctcctgcctcagcctcccgagcagctgggattacagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttc

SEQ ID NO: 17232 - DNA, 432 bp, Homo sapiens
  ENST00000568803
tgtgattggaagttgtcaattgttgaagcattggtaactccagtctctaacgttttagaaaatcataacaagcggttctctaccctgtaaagatttatgtgatcccaatgcaatgcaatgcaattccaataagaatccccatatggtttttgaggaactcagatggaaatgtgaagggttcatgtccttggtaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagtt

SEQ ID NO: 17233 - DNA, 592 bp, Homo sapiens
  ENST00000567639
ggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgagtttcctattaggttaccttgtaagataccatactactggtcactttaaagcccaatgtgcatttataacaaaaatgaataatggatatgaagcttggggtagaataggcattggacttggagctaggagatctagattctagatcgtgcaaatcagtctacctctctgggttctgttttaccctttagaaaactgaacccagagagtggaaggtctgaacatttattttcagatcaagaaagcagataattgtcttaaagatacaatctgaaaagtgcaa

SEQ ID NO: 17234 - DNA, 567 bp, Homo sapiens
  ENST00000565776
aaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtatggttttgtatttatcttttttttttttggtagtggttttgagctctgtcatgtcaattttcatgcgcttaaattatgtgcaatataacatacaataccattgcacgtactgtttttaaactaaagacttaatgatgtctactaaatttcttgggattagtttgaaaagtgcattttcagtgaccacggagtgggtatgaatactgaccgcattcttcctttcttttctgtacttgaataaagaaacataggtttttactttcaggaaattgttgaatatgagagctgattaggaaattgaattattctgagagtcttgcttatcctctgagggttgtttgacaaaaattcaagcttattggtgtttt

SEQ ID NO: 17235 - DNA, 830 bp, Homo sapiens
  ENST00000561545
gacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatacagtctcgctgtgatgcccaggctggagtgcaatggcgtgattttggctcactgcaacctctcccacccaggttcaagtgattctcctgcctcagcctcccgagcagctgggattacaggtgcctgctaccacacccggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacagga

SEQ ID NO: 17236 - DNA, 3446 bp, Homo sapiens
  ENST00000336787
gcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtc

SEQ ID NO: 17237 - DNA, 432 bp, Homo sapiens
  ENST00000586570
tttgctgttacacaggaagagagcaggcagcatcagtatcggctcagcatccttcccccttctgttcgattagaagctgatcgaagcaacagtgccataaagaaatgggctagatatttccagaggctgcaatctggaggcgtttggaggtaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcat

SEQ ID NO: 17238 - DNA, 7281 bp, Homo sapiens
  ENST00000262094
agcgccctgggctctttgaatgagagacatcaaagaaaacacagaacaaaaatgaataaaaatgagctcgctggtaaggctagaagccccacagtgtggagacttcatccccgagaggagtgtgtttctcactgcagcagttgagtcaccagcaagacttgcctgaggtgagctccgcacatccgcgttgggacttgcagacacgccttcttctcacacaaaccttacccagccccgccgccgcggcggactccgagggtggtgccaccagccctgccactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaataggtaaatgtcacacttctgttaaaatgcaggaggtagtgtcataatgccgtctttatattcttaataaatagcactttgacaagaacaggactgtaaatgatgaagtacaagacaaataccctgggaaaaaaaatgaaagtatgagaaattggcatttctacagctgaaattcaatgtatctgttagagatgtctggaagggttacttagccaaattttactcaagccaattaggagctgatattatcagttggaattaagagaactccagaggtttccatttcaaacaaaattttagaaattggtttggtgttcagcttcacatttcattttttcttagcacatgttgataaaatagtcacaaggagaaattaccagttacggtttattaaatctcttttaaaatgcagtcaaggaaaactagccttgaattttttttagataaaataagatggtgatatgaaacaaaaagtggcaattattgcaggtttccttttagtttacaaaagtactggaaactaaatcatatttcttccctccaaatttcacccattcctgactttgaatcaattgcagaaatgcaggtgtgttactttgttgatcaataactttggaacaattatggatcaattctatggtcactctgaattttcatgtcattaatcacataaaaattgataatacctcattctgtattacaatatgattttattttgccaaaggcaagacacctatagttgagctgtattttgggggattgggtgaggaaggacttctgatcttatctcaacaaaaaactggccagtatttttgttaatgtaaagcttccttttctttctaaaaaatagtaacaaaattatttttcattggcctattctgttcttgtgtctaaactaacattacattaatttttaatcttagtttctgataaacacaagccattcctatcaaaatattatttatttcagtcaattttaccaaataacaaagacaatatattttcgtttttttttattatgagcatatgattttttgacaggctgtttcctcgtcgtatagattttttccaatcaaacctactttttccatactctgtgcatattttttgtgaagttatacacattgaagaccctaaaaatcccagtccatcattcagcttacctctgcgaacttctatctggtattgaatcagtttcagaaacacagacagatccaaggaaatgtctctttataatgttcttaggatggactagacccataaatgtgccatgaatcaaaatattaataatttgaaagctttcatgctgttagcccctgatgaaattctcagcattaactggccagctcctctgatttctgcagcatcgcaacaggttcgaagatgggttgtggctgggtattccctcccatggtgtttcctctgggatgctcttcattatctcaatgcctgtgccatgaagatagaaaactgtaagctaacatttaagatgtttcttctggaaggaaagtgagcaggaacaagttatattgccactgctgtggcaaattttggtgaacttttggggtcattatatcaattttttctttggattcaaattgtaatgtcccctgcatttccttaatagggaatgtgaaacctttataaaactctaaaagtattctgttttgatatgtctttttgtttctattcattttcagttatatgattgatttacttatgccaagattctgtcactgtcagttatttaatgagtgttttttcagggtctgttttaagatcattatttgatagctgtagcatgaagcagaggttgatgatgcccataattgcaagactattcctgtaaaaataacaattattgggtaataacttcaagaggaatgagaagtgacaaaattgatttaaaatattgttctacttataaataaatgcttgatataaaaaattttctccataaagtttgacatctgaccccagattctatgtaatcattattagaaattccttctctcattatttcaggattagtagttctgtgtaattcattttacaatttcaaattgttctggtgccataaagtatacagactactttaaagatttccaaatcccctaatttaccccacaacagcatgtaattttagccaagatatgtcctgttactaagtatctcccaatgctttagtaaaacgtatttaggagaaatgttgaaaatgtacatgaagctcctttctgatatagaaaccatttctggagtatttacactggtttgatgtttacattgctctaactcggtgcctcagatacctctgtgaccaaatttgtctccaaccacatagctcatttcctataatgttatatcataggaagccctcacagagacactaacacagctaaagatcttctgatattatcagcaagggatgcaaggactttattggaatctggagagtttaactgccttctcttggtctcctcacttacttcttatgaagttggcattacctgagactcttagctgtgattaggtacaagcttaccttttagggtagaaaaagaaagatcatttgaaaaatgtatctaaaataatccagagaacataatgtttgtcttggtctgataatgataagaagtcaaggattggcagagaaaatactaaacgccaagagttgagcctgtgggtctctccataagagttttaaaactcttgccagttaccactttatccaatttgctatcattttcgtattatcagctatcgccctgtaaaatattcaaaactagctatttctaaagtaaacattttatctgttacttttaaccagataggtgtctttgtcatccttctactataaattgttctttgccaacctgtacaggtagatgaaccaggcgagagttttaatcagccttttcttgtcccctttgtaagaaagagatgcttgccatagagaaggacatgagtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatgtataatctaaaactcaacaataaagaaataatattccaagtctctggtttcctaagatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgccagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaaacaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 17239 - DNA, 597 bp, Homo sapiens
  ENST00000586594
gcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggccaactgcaagcaaatgcttattgtgaaaatccagatatagtattaattggcaacaaggcagacctaccagatcagagggaagtcaatgaacggcaagctcgggaactggctgacaaa

SEQ ID NO: 17240 - DNA, 423 bp, Homo sapiens
  ENST00000592334
tttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatgtataatctaaaactcaacaataaagaaataatattccaa

SEQ ID NO: 17241 - DNA, 4055 bp, Homo sapiens
  ENST00000578921
ccgtccgggggcgttcctgggagctgggggccggcgaggctggacccgacgcgcccgggaggagccggccggcggccacgtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgagttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgtggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 17242 - DNA, 783 bp, Homo sapiens
  ENST00000578734
aaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcgggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcaggggg

SEQ ID NO: 17243 - DNA, 469 bp, Homo sapiens
  ENST00000581109
ggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagtt

SEQ ID NO: 17244 - DNA, 714 bp, Homo sapiens
  ENST00000583137
agaggcgagagacgccggcggggcgcgggcgcggcggccccggaggatgctgctgagccccggcactgcctggctgcgagcacatgatggcgatacgggagctcaaagtgtgccttctcgggggactgatggaaccgatctgttcccttacgaagtgtcacagtattggcaggactctggacaaggacaaggaaggctgcattcctgtggcaccaccaggtggaagatggaggtatgttctcagaacacctgcgactgggtaatatataaagaaattggctcacgattctggtggctggaaagtccaggacggggcagctgcatctggtgagggcctcagtctgcttccactcatggcagaaagtggaagcgaagtgggtgtgtgcaaagagatcacatggtgtgaaggacagaggcttagccatgtgaaatgtttttgctcaatgtcataaaggccatgtgggaagtggaccctaagccaggcagtgtgactgctccagggttcccagctccacagtgcaggaggtcaaaacaaccttgatgttatcgtacttaccgtaaatcttgctgtaaagcagttgttccgcacatcccttctgaagcacggacactgtccccctgtggtgcgtaagccctgggcctggggatggtagcacagggatcccccatttcgcctgtgggccacccgagacgcggctcctgttcatacgtccc

SEQ ID NO: 17245 - DNA, 518 bp, Homo sapiens
  ENST00000435762
gttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacgggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaa

SEQ ID NO: 17246 - DNA, 328 bp, Homo sapiens
  ENST00000578737
gggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagatgctgtcctccatccctgagtgtcatccgtgtagatgctgtcctccatccctgagtgtcatccct

SEQ ID NO: 17247 - DNA, 583 bp, Homo sapiens
  ENST00000583921
agcgatgcttctgcttctcctgctggcggacgttccctgatgacttgctgtgttccatgtactgttctgagtgcctgtgtgtactgatgcattcagccctcctcgcaaaagcactttgaggttgaaactgtcgttattcccatttgcagtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatc

SEQ ID NO: 17248 - DNA, 367 bp, Homo sapiens
  ENST00000580361
gaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctc

SEQ ID NO: 17249 - DNA, 295 bp, Homo sapiens
  ENST00000577796
gttactttccacgagttcctgaccacttctacctaaatgtggtgtgttgcccttggcctgttttctagaggacaattgattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcag

SEQ ID NO: 17250 - DNA, 272 bp, Homo sapiens
  ENST00000577371
gaggacaattgtgagtgaagggccaacaggaagacaggactctaaatatatatgtttcttccttggtgattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctct

SEQ ID NO: 17251 - DNA, 342 bp, Homo sapiens
  ENST00000580795
gatcggtgtctggtgactcttggtaattggtgctgcgcggcgaaggagtggactgtgagaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaacc

SEQ ID NO: 17252 - DNA, 604 bp, Homo sapiens
  ENST00000577284
ggaatgctgactctctcacatctcaaaactcttcctaccaaaggagaaaaatgaagtctgagaaatattttactctaataagtgaaattttgaatattctgaagataaaagaacctggcactcctaagaagccatgttcaacagctgattcaagagtgctgctaagagttcaaaacatgcaggaggggagtcttcttgagacagagccaggccttcctcaattttgcattctgtgcatcagtgctcattgttgactggggagagaaatgagaagcagcaaagaggaaggaggtggcggaaagcggggaaaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaaccc

SEQ ID NO: 17253 - DNA, 1258 bp, Homo sapiens
  ENST00000257017
cgggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 17254 - DNA, 1597 bp, Homo sapiens
  ENST00000395243
cgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 17255 - DNA, 994 bp, Homo sapiens
  ENST00000625712
gatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 17256 - DNA, 1592 bp, Homo sapiens
  ENST00000301043
cagccttgaaggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 17257 - DNA, 1184 bp, Homo sapiens
  ENST00000450529
gatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 17258 - DNA, 1293 bp, Homo sapiens
  ENST00000415040
ggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 17259 - DNA, 745 bp, Homo sapiens
  ENST00000484161
gaatgatgtggcatctctggaacataccaagttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacga

SEQ ID NO: 17260 - DNA, 1201 bp, Homo sapiens
  ENST00000422279
ccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagttccaagaaggatctgagtacccctgctcagtatgcgctgatggagaaagacgccctccaggtggcccaggagatgaaggctgagtactgggcagtctcatctctcactggtgagtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgtt

SEQ ID NO: 17261 - DNA, 1108 bp, Homo sapiens
  ENST00000474704
tccttccttccagttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagttggaggctttagggctctgctgtgacactcttgcctggctctcctctcactgctacacctccagctgtgccctgtgtccccagacccagcactgcccctgagcacctatctgctctctgtgtcaggtgagaatgtccgagaattcttcttccgtgtggcagcactgacctttgaggccaatgtgctggctgagctggagaaatcgggggctcgacgcattggggatgttgtccgtgagtgcttgcctggttgagggtggcagagggcacagtgagcctccaatccctgcttcacatattttccacccttctttaggcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatt

SEQ ID NO: 17262 - DNA, 863 bp, Homo sapiens
  ENST00000436730
tgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttc

SEQ ID NO: 17263 - DNA, 914 bp, Homo sapiens
  ENST00000430132
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgccc

SEQ ID NO: 17264 - DNA, 467 bp, Homo sapiens
  ENST00000583538
agatgctgcgcagcagtctccgattccccatcaccaattcggctggtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgcc

SEQ ID NO: 17265 - DNA, 1180 bp, Homo sapiens
  ENST00000636772
gagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtcc

SEQ ID NO: 17266 - DNA, 1060 bp, Homo sapiens
  ENST00000353676
ctccttgggccccttctctccccctttcccctccctgctggttcctggcatcgccagatgctgcgcagcagtctccgattccccatcaccaattcggctggggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 17267 - DNA, 717 bp, Homo sapiens
  ENST00000412625
cacaatctacacagcagccttgaaggaaaagacgccagacttcagacgtctctctcctcgggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 17268 - DNA, 434 bp, Homo sapiens
  ENST00000496866
cactcttccagccatcatcattgtcttcaacctgaatgatgtggcatctctggaacataccaagcagtggctggccgatgccctgaaggagaatgacccttccagtgtgcttctcttccttgtaggttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagttggaggctttagggctctgctgtgacactcttgcctggctctcctctcactgctacacctccagctgtgccctgtgtccccagacccagcactgcccctgagcacctatctgctctctgt

SEQ ID NO: 17269 - DNA, 888 bp, Homo sapiens
  ENST00000636513
atggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccaggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactg

SEQ ID NO: 17270 - DNA, 626 bp, Homo sapiens
  ENST00000419712
agatgctgcgcagcagtctccgattccccatcaccaattcggctggggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatg

SEQ ID NO: 17271 - DNA, 711 bp, Homo sapiens
  ENST00000481501
caacgacccagtaaaatatatactaactttacttaaatgtttaaactgaggcttagagaggctaaataacgtgtccaaagtcacacagctaatcagtgtgagagctgggattcaaattcatgtctctctgcttctggagcacaaaacactcctcctccccagcacacctgtccacgcagctgcctgggatgcctggtgtctataataccctcagcctgggtgcagctacctttctggacctagtcgggagcattggaactccctagggtgaaagagctcgtgcccactccccttgcccactcttgtgtccagcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctgtgagtgcttccacaccccttccagctatcccttctccccagcacccacaccccccaagatacatacctgtgcttcactcttccttccttccagttgggataccgctgggcaggagaggttcaaatgcattgcatcaacctactatagaggagctcaagccatcatcattgtcttcaacctgaatgatgtggcatctctggaacataccaagtaagtgagcatcctgc

SEQ ID NO: 17272 - DNA, 730 bp, Homo sapiens
  ENST00000636154
atggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgag

SEQ ID NO: 17273 - DNA, 527 bp, Homo sapiens
  ENST00000636534
tatgagtcacctcccaggcctggagttgaggagggaagcgccgcctctccttgggccccttctctccccctttcccctccctgctggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctg

SEQ ID NO: 17274 - DNA, 582 bp, Homo sapiens
  ENST00000580843
agatgctgcgcagcagtctccgattccccatcaccaattcggctgggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaa

SEQ ID NO: 17275 - DNA, 1253 bp, Homo sapiens
  ENST00000483554
tggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggtgagttagggacacccacaacaaagagaggaggtcccaggaaactctgtagtcatagcgagggtaaacaaccacccccttggggcttcatttcagcccctaccagctatatggttatttccccctctttaagcccctgtatcccctccttttctcccaacaaggttgttgtgagttctatgagatggggttgggtagaagggtggcagctggatttctgagtagagactaaggtgtctgaaatgggaaggtggtcacctgctcagatccccacatagcatccatggagccccagggcaggggtctggctgtgcttacagggatgagtcttattgtgggttttaaaggtaatactgataacagttggcaccattaattaagcatttgctgtgtgccaggcagtgttgggtactatcatctttattgaatggaaaagtccatcacttaagatatatcctgatttcagacattaaaatgcgggggggagggtgtcttagaatataggacatttatctcattttaaccttcacaacgacccagtaaaatatatactaactttacttaaatgtttaaactgaggcttagagaggctaaataacgtgtccaaagtcacacagctaatcagtgtgagagctgggattcaaattcatgtctctctgcttctgg

SEQ ID NO: 17276 - DNA, 498 bp, Homo sapiens
  ENST00000482688
agatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggtgagttagggacacccacaacaaagagaggaggtcccaggaaactctgtagtcatagcgagggtaaacaaccacccccttggggcttcatttcagcccctaccagctatatggttatttccccctctttaagcccctgtatcccct

SEQ ID NO: 17277 - DNA, 546 bp, Homo sapiens
  ENST00000582934
agatgctgcgcagcagtctccgattccccatcaccaattcggctgggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggg

SEQ ID NO: 17278 - DNA, 1099 bp, Homo sapiens
  ENST00000453384
tatgagtcacctcccaggcctggagttgaggagggaagcgccgcctctccttgggccccttctctccccctttcccctccctgctggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactt

SEQ ID NO: 17279 - DNA, 1766 bp, Homo sapiens
  ENST00000395245
aggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactt

SEQ ID NO: 17280 - DNA, 3804 bp, Homo sapiens
  ENST00000340415
ttcatcccctgccaggagagcatagtagctcacatttattgagttcttagtacacgctgggcactgttctaggctttttacatgaattaactcattaaatactcagaacaaaaccatgaggcaggtactattataatattatctccattttgtggacacttaggaaagattaatttgcccgagtttgcacgactaataattttcagaatcgagatttgaatcctggagcctgtgctcctaaccaaaccaccatctgcctctcctgagcccattgtccttaacttcttgcggtcatgtgtgctggagagaatgtgatcaaagccctggaccttctccctaggaaaacgcaggtaaacagaattttgcatatttcagggactttggggacacctaagacccatctactgtcgacctcagacttagaagctctatttatctcatacatcctggagagaattgtccagggacaaaaacagaagcgccgccagcgccgcaggacttcgcctctgcaaacgtgtgaggagagctgcgctgcgctgagctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 17281 - DNA, 1560 bp, Homo sapiens
  ENST00000402449
gttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtct

SEQ ID NO: 17282 - DNA, 3780 bp, Homo sapiens
  ENST00000392617
aatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 17283 - DNA, 1494 bp, Homo sapiens
  ENST00000528438
aaagctctcccctggtgggacattctgggcacaaccaacaggccgggggaaatgagaggtgatccatactaaagggtcaaagtccccgcaccaggcagaggccccaaaacaccgcagcgtacatgtgctgcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacct

SEQ ID NO: 17284 - DNA, 2655 bp, Homo sapiens
  ENST00000392615
ggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgag

SEQ ID NO: 17285 - DNA, 2704 bp, Homo sapiens
  ENST00000392614
gactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 17286 - DNA, 2617 bp, Homo sapiens
  ENST00000392613
gttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgag

SEQ ID NO: 17287 - DNA, 578 bp, Homo sapiens
  ENST00000533530
tcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatcc

SEQ ID NO: 17288 - DNA, 559 bp, Homo sapiens
  ENST00000527040
ctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaag

SEQ ID NO: 17289 - DNA, 950 bp, Homo sapiens
  ENST00000577548
ctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggagtacggtgttcccttcctg

SEQ ID NO: 17290 - DNA, 2528 bp, Homo sapiens
  ENST00000392612
ccttcgcctgcgggccggcactgctcacctctcgtccagggacatgacgggcacgccaggcgccgttgccacccgggatggcgaggcccccgagcgctccccgccctgcagtccgagctacgacctcacgggcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 17291 - DNA, 2858 bp, Homo sapiens
  ENST00000392610
ttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 17292 - DNA, 1654 bp, Homo sapiens
  ENST00000481224
acatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 17293 - DNA, 2195 bp, Homo sapiens
  ENST00000488977
cttccccagagtgacccatttgggcttgacaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 17294 - DNA, 561 bp, Homo sapiens
  ENST00000531420
atttgggcttgacaggcggatatgagcagcgaaagagtgatccgttccgaagacggagagaccttggccaggggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttg

SEQ ID NO: 17295 - DNA, 1653 bp, Homo sapiens
  ENST00000613645
acatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 17296 - DNA, 1528 bp, Homo sapiens
  ENST00000222256
ttatctacatgtgaggctccgcccctccctttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatccatgtgtgtccctgtga

SEQ ID NO: 17297 - DNA, 1253 bp, Homo sapiens
  ENST00000464076
gcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaaggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcca

SEQ ID NO: 17298 - DNA, 579 bp, Homo sapiens
  ENST00000481914
gagccgctgctgccgccgccgccgcgcagccccacatcaacgcaccggggtcctgtcaccgccaccgccaaaaaagtcaccgccgctagggtcgccgttgcatcggtgcagggcaagggtgtcctccatacaccggccgttttctggagcccttgccatcttctgcctgggcttgggcacatgaggatggagagagcccccctcacggctctgctacacccggtatccccagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactg

SEQ ID NO: 17299 - DNA, 543 bp, Homo sapiens
  ENST00000515410
gtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggtgggtcccagctggagggctcccgcccggctcggttggattcccgtacttggaaaagcagccccaacctcgtctatctctttcctgactggagtcattcacttacacactgggcatttatcagtaaggtgcccactgtgtaccggggcagaaacagcacctgtgttctcccata

SEQ ID NO: 17300 - DNA, 12844 bp, Homo sapiens
  ENST00000371655
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagaccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatccagctgtggctcacacctgtaatcccagcactttggaaagccaaggcaggaggaacacttgaggccaggagtttgagaccagcctgggcaatgtggtcaaattctatccctacaaaaaaaaaaattagccagatgtgatggtgcatgcctgtagtcccagctacttgggaggctgaggcaggaggattgcttgagcccaagaatttgaggttgcagtgagctgtaattatgccactgcattccagtctgggtgacagagtaagaataagaccctgtctctctgtctctctttctctctttttttttttaaaggagtcagctctacaaagatgttgctttctttgatgcaatgcagagagcagagctttggacttggaatcaggagacccggactctgtcattaaatcaactgtgactctgggccagttactttccacttttgagtcttgatttcctacttataaaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactcatttatcttcccaacatcttgtgagggaggcactatagtgagcctcatttgaagatgaggaaacaaaggtacaaagaggttctagctggacctctaaagtcacataataagtaagtggtagagctggagttcacatccaggcagtaggctccaaggtctgtgctcttaaccacattctgggctgcatcttttatagacaaactatgatccagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgaggcaacagatcccatgggcctgggtagaaaatgcccagtgcttcccagtcccaagtgctggctttccctgtatctgcctctgccaggcaacacttatcaggctcccaatcagcaggagcctccatgctccactttgaacagcctctatgctccagcaatggggcatttgtgaagagtgacttgattaacttttctgaccatgggtataatacagttgcttcagagggcagtggttctgggtgtgatttttacactgtaacattgtatacagtgtcatggataattactatttttttctggtcattaacactcacctactctagtactaggatttcagaccaaggtcctcatgacgcctggatattttagtatctatatccaataatcttttctctcctactgaatatccaggcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaatcacagtaatagcgcaattagccaccaaggttcaagctgtgtaatatgtgttagtggcaacttgtcctggatttaatcttcctcaacaatccaaataaaatatttaaaaactcttgacttctggctgggcgcagcagctcatgcctgtaatcccagcactttgggaggccgaggtgggcagatcacctgaggtcaggagttcaagaccagcctgggcaacatggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatggtcacagactcatcgattatcagatctggaaaggagcttagagaagatctgttccaggctcctattttatagaagggaaggttgacatccaaagaatggaaggaaatctcctaattattctgagagtatcacagtgatggagccaggactaggtcctggatcacctctaagaagacacttagctatttgactatcgactagggcctagcattattaagcactagataaatacagatgaaaaaaaaaatgatccctgcctgcaaggtcctatgatctaatggagatgctgtttctaaaatattattatcccaatttggcagtcaaggaaacagccctggaaaagttaacatgctcaagtcacccactagcatcatttgaaccctcctctgtctgactcatgctctttcaaatttttttcttcagattgtcttagcagaagggtagatgggatataccctctggtagtaccaggctcccaaggattcttagagttaaataacctcagttaattaaatagccacaattgcttggtgaccgaagccttataacatccacagaataagaccattctccagacctgactccccaactcatatcacctgctcctgccggccactaagctccttgcttggatatcgagttttctggagtatcctgaggaatgtttgtttgactttgtttgccaacagtttaggggaaggggaaagaactacaataaccagtgtcctgggatctcattgatttcagattccctgccccaagcctacacccaattacctgccatagttggggaatcaagtagcatcctgtggctggaagtaaatgcaaaacactagtccgtgagatataaatactgttaaatgatggttttttaaggtcctgatccattatatgaagtagacaaaattcaaatttatttattcatttattttctcaacaaatgaatatatattatgtgccaggatacaagtagtggcaaattagacacagttcttgctttcatgaaacgtatagcttcatgatttagtatagacattgtcaaatcatcacccaaatataattacaaagtactctaaaggaaaggcacgtgatgctgtgagaacactcaactgggaaaccggaatcacctttgagaaactgtttcaggggctcttggaagagtctactgctcccaaatatctctgctacccactggccattgctttacattcctcaactaagctttcaccttttagtactaacctttgatgactgatcaaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggaggctgaagcacaagaattgcttgaacccaggaggaggaggttgcaatgagcctaaatcgcaccactgcacttcagcctgggcgatagagccagactcagtctcaaaaaaaaaaaaggggagggggaaatagatgccatctctttatgggaggagctacaaaatatggtgaccaatttttcaatctaccacaggaagcaccctcagtcctctgaaactaagtctggtagatgtcctggggtcttaaaacatggctccgatgatatcaccaaagacaagtggcaaaactgtatagggcagggcagtcttatcatttgtttaatagtgatccaaaggatttactttggaggaatcaagacactcgagatgaagaagttttgatgcttgttaaacagtccatttggatacctcttagctatccccgagggatgaatctgacttctcatttcacaggattcaccgtagataatggttgtaattcctaccggaagttcctggccagaagcccagcagaaagattcagtatatatagaaaagatggctccaagaacagttgggccttctgttctaactgtacttccttctttgatgtactcgtctagtcccgaggctttagatgccaagtctttgataataacgtgtatctaagtgcctactggacattttcatgtctcaaacttaacatgtccaaattgaaactcttgattctgcccccaaacttgtttgaaccccagtcttcacagaaaactcatccttaattctttgatttttctctttttctcagcctccttgtctaatctagcagcagatcctagggttttacttctaaatatatctcaaatctgatcatttttctccattttcattggcatgaccttggtccaggccaccattgttttctgccctagagagctaccacagagttcctaacatttccctacttacgtaattactccactctagtccattctgtctcacaggagtaacattttttatatatatatatatatatatatatatatatatatatatatatatatttttttttttttaatagagacggtcttgctatgttgcccaagctggtttcaaattctggcctcaagcgatcctcttgccttggcctcctgagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaagaaagaaaaaaaagaagaaaaggaaagaaatgaagagaattcagagacttccattattattaatacctattttattgattctgtttctagccctgagtccgctcctaacttgctataggatctctggtaaatcatttcctgtaataagcagctgtcacctctctccttgtttcttccagaaatagtaatctcttctttagtagtactactactccctaacccaaaccaggtgattctagtgaagactgtcaataaacggagcatgtgatcaagcagggcccatcagaatccttccctaagatttttataaaaagctggacctattctttttccatttgagtggcaaatatttgaagatatgaggtctaaagctgtgatggcttattctccatccctgtgtaaattctggtctatagtaagcgaaaacaaggccattaggcagagggcagcagagacataaggtgagaaagagtgtggtctctggttttctagaccctgattctggtttggaggcttggctgatcacctcttcctttgattctgatagaaagctcaatgtatctttctaataaaacccccctttgctttgcttgttggagttaggttcttatcccttgcaaccaaaaatatattgtctcttcttttgttctcagttttctcatttatatatccttctagctccaaagcacagaaattctaaaacaaacaaacaaacaaacaaaaacaaacaaaaaaaacctgggtcattcagaaaatcccactgatatagactttctgatccagaatgtataatctgaaaagaagcctaccctcgtctccatcctctcttcttgtacctgaaggaacgaagaagagggatttctcaaggtgagaagcagttctccatggacactgatgacagcacaggcaaagtttcctatgactagggatcactgtccacacagagtctggcttcccaggtatccagcaggtagacaaaacagctaactccactgccactcctttctccacatccgttcctatttctcagccatctcagtgacatccgccatcttgagagtcaactactgactggactgagttgtgtggtatatgcttctgtttacttctcttctgtcttttttaagtggccaaatagcaaacgcttaaataggaaatctctgggagacttgaataaaagactttgcttggtagaaaatcatgtcacagaaaggctaatagacagcaaagtaaatcagcaagtccctgagcagtaggattaggattcctgtctcctttcagattcaaatgcatctgtttctggggttaacagtggactgttaagaggctgtgcagcttgggttaagtcattcttatctctgggcttcaggagcttagaccagatagtttctacaggctctcttggtgctgatgccttgggattctgtggctgttttctgtaagatctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggatggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtagacatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacacagtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttgaacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtattcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 17301 - DNA, 423 bp, Homo sapiens
  ENST00000513316
gaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttggg

SEQ ID NO: 17302 - DNA, 8896 bp, Homo sapiens
  ENST00000282878
agtacgcgtgtgcggcgccaggagaggacagctccagtgctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcatgtgacttgttatttatttgtctgctaggctctttttgtttcaaatttgttctcagactacttctgggacatcagactataatctcactacaactggcttttgtcccattgattcaaattatgctattcacttgtaggaatgatgaccaaggaattgcttgtgtgtgtgtgtgtgtgtgtgtgtgtgcacgcatgcccgcatgcgtgcagaggaagaagtcacaagacttcatttgctttactcttagttgaaaatcaaatggaagtttttctcatgattagggacgctgtcacgagtctggtcagtttactgttgggaactgtgtctttatttcactgttattaataactgagatcattggcctataaagaaattgaaatgttgtttttaaggtccttgcaattttcctaagtcattaatattacctgactggggctatttaacaataatcttcgtttacacatttaaataagcaagtatctacccaggactgctttttccactgatccttcccaattctgtgaatattcaacatcattgaacagattgagacatatctactgaatgccagttatgcaacaagcattttaaccaagaagggtatgagtagctatggaattccaaggtccaagcccccttatttttcaatgacttgccttccccaacccccataatgcacaccaccaccaccatcactttctggaaccatcaccaactcttggactagagcttatgttgaagcttgttagggctcctctttccgtaggatgtagacttgcctccccaaacacggccatcttctcaaacctcagctaagttcttttacctgtttagatgctatttaaatcagatttcaaagggtccccagttgagaaaaaggaaaattttaatctttaatcatctttttaagtccagatgttcataaattctaaagcatattcctattacgtgaatgcttaagttacacaggaaacattctataactgtagtatttcaatttcagaaatatttaggatccatagcaatttaaaagagggaggaaaccactggagcattctaattttgtatcacaaacttcctaaaggacctatatgaataaagagaaaacaacaaatcctaccagctgtacagagagcaacagggaaatttggcctctgtatcactgtccagcattatttaaagctaggatttaggaaggaagcaggaattatttggcagatttggaaggatagtttcgttaagtgaactttctacttttttggtggttatgtcaaagaatttttttcctcttctcaaaaatagagaggcttcccatgaaagtattggatgcaaatgaaacaggcatacatctaaagatatctttggagaataaatccttacaagtcacagaactaggtcacacacattagtaagtcaaaagttggaaattaggggagagagcatttggaatgctttaagcatttccatgttatttctcaccttcctagttgaagatccactaatcagtagtacatttctactttggtgccctacaaagcaaaccttagcatagtaaagacaagaaaacattaatgttttattagtttttaatggggcaaccaacttcaaaatcacaggaattacagtgacgggagagaaagaagcaggaggcataaaaacagatttgtttgtagcagtagtctgtttgtacaatgttataatatttctgtaacttgggccagaatgtggccatgttaaatgatatagctattaagctcacttttacaatctaaaaggaactaataaagccaggaaacccttctcatcctccttcacagccctcatcccacacatagatgtaaaaagcttagaaagaatattctgatggctttttcagaaggaaggaccttgatgtgtgtattgtggtaaaatgaaaagcaaaatgagacagtatttaaaagtgaaagagcagagttttgctctgctgaaaaccccttccctgaagaactgattgctgttgaagttaattggcccttagatgggaagccctaagccaagctcccacttacacagtgtcaaacatcccgaagtggaaacattttatgccagtcaggggagagacaggcaacaatagcccaaatgtcattgccaagaaacatctgatactttctaatttctaaaccccaatggaagtgaggcctttttcattgattctcagttctgaaactcccaccctgttaggatttccattccaaataattcaatgagaggtttccagagaaacagtcacagagctcaagagaaagaacacttaaatgctcctgctgtaattgcatcaaaaaatccgggttttaacatcaaatttggcaaatggtgggaccaacccaaggttaactaagtgggctttcattggcattgagctatgttacttataaattataacactatagttccaaggtttttcagccttttggccaacacacacacacacacacacacacacacacacacacactataccatcatctatcaatagtctaaatacataaataaatgcaggtcatttttatcaatggcctaactaaatttatatttaaaagaacaagacttttaaaaagtacatactcctgttggtttgtaagttatacacatttatctcttgtctttgatttaattaaattagtgttttaagtatgaatttattttcctttgctactcattacctgaccactttcactcctctagatacccttaggaataaacctgaactgttccaaatcgattcttccaagagctttggtgttggtaccttcctttcttttcctaatgcaactgaaaaattagactgaaaattatttgacttaaatagccatcctcagagtgaatcagcatttcagtttttggagatggggatggaagtagaaggtgcacaaagcgtcctaagatggcagtttgaatgttagcatcgcatctacatgctcataagaggaattgcttcaggacaatgaatcagttcattgttgctgcccccagtgaacagctccaactgccttgatgaacttctaatgactgtgaaagctaggaggttcttctagttcctccttagggtcacttgaagttcagtatttttttgctgcctggtaactaagtgctaagatttttacttggaaagaaaactatgacaatgccttcagttgtagcagaaagttgtggcattgtgataataaacaaaatctacaaagttacaacccaaattatacaagacatcaaaacactcagtaaacaaatatatatatttcacctacttaaatcttattcatattaattataggccttttgtttagtacactggttattttttaaggaaccaatttaaactttcaattttaaatacatctatgctgacgatagactttcgggtatatacaaccttcttcttctcttttaaaagttaaatacattccactattaactgaacttccatgaagcaacattaattttagagcatggtagtccataatcagtggttcattgtgatgtgctttatccaacatgtatcttagtgcatggttgaggatgtactatgtgatattttagttaacagtgtggcatttgtgggactatattaaaagcatatccaaactaccaagctataccaagctgaggtaggtaacacctgcatgtgaaaaactgtgatatgaatcttatttataaaaaagtcataactaaaacccttctagaccaaaaagttactgtgtgtttgttaataatcttcatagtactactggaatgctcaatcagttatttttggtgtggcatacttcagagctggcctgtccgtctgaagaaccctttctctcacaattacagtttgcatgactagaacccggaactctgttcctttgcgtgtatagtcacttagtgtgctgtccgggtgccacatgagcaactacacccatgtggcctttctgtcactccctggaaaatgcaacctctacagctctgctcagctctgcctgtgtgcattgattaccttcgctttagtagtttgcctgtaaaatggtgaagtctttctgatatgctgaacctttgagccagcttttgggagttcttcatattttaggtgaatttttgaccaaagtcaattaaagacataaacctgttttatatcatggaatttactgggccaaattaagtaaaagatgaagtttatgaccagaataaaaaagcctttacccctgcacagcactgtatctaaagggctctaggttgtagaaatatagtaccccctaacagggaaaaaccaagttgggggatttatctaaaatgtatctacctattgttactggtatttcacaaataatttttttcttaaaaatatttacagaaatgcttgacactccggtcaaataatatttccctttgatagattgaaatatttgcttttagattacacatacagtgctgcccttctcaacagtcactcacacgctcactcgcctgtacaaaggtatcaggcaaacactgatacttttttttaagaaggcaaaattccatctatggtgctttctcagtgctagggaaaagggagcttttactatgttccagctataactcacatcttacttataaggtccataaaatcggttcttcacactgatttcgtttgattagtctgtgcatgtaattaatttcctccaaacagagagagtggaggggaaataaattttgcaagcattctagataacagaaatgagtcattttaaaacctcactcagagctcgagtgttaagatcagaccatctagctagtggacaaattgaactttctatttgcagttctcttttactttctgactttcttttaaattactgcagtttttcaaaacactatcctcatggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatcgtggacaagtgagagttggctgtggctttatttcttgaggcaaattattttgcattcatgttatttggggctaggtattgcttaggttcgtgaatgctgttcttacagacacagatggtacctgagcccctcagacacctgccctttcagggacgtgagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacgaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctataaagaaagtggtttttgttctttgagtttgttttatttcttgaagattacaataaatatctaagagactatattcctgaa

SEQ ID NO: 17303 - DNA, 590 bp, Homo sapiens
  ENST00000507977
gataccaacttttcagagtgctgagaggatttgatggcataatttgtgtaagatgcctagccccgtgcctgcatgatctatactttggctgacagtccgtgccttcaggcagcctcacaagaatatctgagaacagacagtattgcgttgcatccaggatttggtatggacaacttatcctgctccctggtgccaacacaatatttcacaacagacaataaaactaaaggacacagcaggccaggaaagatacaggactatcaccacagcctattatcgtggagccatgggctttattttaatgtatgacattacaaatgaagaatccttcaatgcagtacaagattgacagaatttacaatttaaaagaaaacagaggaagaaaagtagaaaaaaagctggcatgacacaaaacaaaacacagaagcttgtgggaaccatgataacttactgatttttctggctgcaagattgtatgaaacaaaaaatagcaatatataacacttccagtttccccccgaagcaggcatgaccaagctcgttgtggtccagattgtctaaccagttatgctttaaaaaaaaaaaacatt

SEQ ID NO: 17304 - DNA, 583 bp, Homo sapiens
  ENST00000381158
aaaaacagccaaagatggctttgtgtttaatgcacttgctgtaggctgaaagccccagctgcactgccaccaccttgccccctactcctgccaggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaata

SEQ ID NO: 17305 - DNA, 5526 bp, Homo sapiens
  ENST00000285208
ctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctcaaaa

SEQ ID NO: 17306 - DNA, 500 bp, Homo sapiens
  ENST00000469959
ccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggg

SEQ ID NO: 17307 - DNA, 880 bp, Homo sapiens
  ENST00000486858
gagattttgggaatccactgagaaaattcaagttggtgttcttgggggagcagagcgtgccctgggttccctgactgctctggccttccatgggtgttctgcgggactgctggcagcccttccggactcctccctctctgctacctgctcaggttggatgtggcatatgaccagaaactggccattggtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagta

SEQ ID NO: 17308 - DNA, 586 bp, Homo sapiens
  ENST00000477759
cggccccggctgccagcaccatgtccgcagggggagattttgggaatccactgagaaaattcaagttggtgttcttgggggagcagagcgtgccctgggttccctgactgctctggccttccatgggtgttctgcgggactgctggcagcccttccggactcctccctctctgctacctgctcagtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcg

SEQ ID NO: 17309 - DNA, 723 bp, Homo sapiens
  ENST00000460865
tggcgcggctctggagagcgctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataacca

SEQ ID NO: 17310 - DNA, 506 bp, Homo sapiens
  ENST00000488969
gttagtctccttgctgcccagggatctgggcaattgcagtgagggctaccccaactcgaggcgatttggggaatgatacaggggcacctcacaccgagaggctgtgaagtctggctctgggcagagaaaggcccaggcgacacgccctgcctagcttcccagcactcctccagagagcatcggtggattcttcccacccccacctcccagctcaccgcccttcttgggggaggggaggtcaccctggcagtcggccagagctgggggagggggagactgcttctccgctgcccggctccctccccaggaaaacatctctgaaaaccagtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacat

SEQ ID NO: 17311 - DNA, 5219 bp, Homo sapiens
  ENST00000543906
acgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctc

SEQ ID NO: 17312 - DNA, 2037 bp, Homo sapiens
  ENST00000415486
acacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaa

SEQ ID NO: 17313 - DNA, 2377 bp, Homo sapiens
  ENST00000360011
ggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 17314 - DNA, 2317 bp, Homo sapiens
  ENST00000331511
agcgactcggtgacagcggcgacggcggctcccaccgcggcgcacccccttcaggcggccggcggcgaggccagaccggagagttccagcacactcgaccaccccgcggcttcctggaggcggcggccgcgattgcgaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 17315 - DNA, 463 bp, Homo sapiens
  ENST00000509491
gcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctgcccctgtgcctcggggagagcccagtggtgatgcccattcacatgcaggtggagggaagctccgcaccagagctcaatccgaatggcaatgccacctacgtcatgaccac

SEQ ID NO: 17316 - DNA, 2224 bp, Homo sapiens
  ENST00000451717
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 17317 - DNA, 2421 bp, Homo sapiens
  ENST00000545871
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 17318 - DNA, 1970 bp, Homo sapiens
  ENST00000495034
gccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagtaggttggatcttcaaaagtggtttgtataactttgtcctgtcctccacctttctatccctatgtatttaaacatctaaatcctacatggtatcatacaaaggactaatccagtggtttacagcagtaaaggtactaacatgtattacttcttaatcacttgttatgattgagccaatatacaaatacctcatctgttctttttaatattttatctctgtttgtagagagctaacgtttgatagttctaatttaaatttcttcctttcccccatattcaatcattgaatccttatagaatttgtcttttaatagacagaaaaattaatgaaactttttaaaatagaaaaattactcttctttaatgctaagtattgacacatcgttgtttgtttttcattgtttttgcggattgagagacttggtccatcttgtctcaggagaagaaacctttctccaatgtagcagaattatcctcttccctgtattatagcaagttctttattaaagatttttgaggccgggcacagtgactcacgcctgtaaccccagcactttgggaggccgaggcgggtggatcacttgaggtcaggagttcaagaccagcctgaccaatatagtgaaacactgtctgtactaaaaatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtct

SEQ ID NO: 17319 - DNA, 5834 bp, Homo sapiens
  ENST00000367635
gccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaa

SEQ ID NO: 17320 - DNA, 906 bp, Homo sapiens
  ENST00000324778
gaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtag

SEQ ID NO: 17321 - DNA, 671 bp, Homo sapiens
  ENST00000477383
catcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggaga

SEQ ID NO: 17322 - DNA, 662 bp, Homo sapiens
  ENST00000415888
tcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataagtcagcatttttaattttatctttcaaatttttaagtcttttgtaattggatttattgtcgatttattagttcagtagaaaatggtatccttgaatagttttcttttttcttaatagctgttttctgattcagtaaaatgccttgtttgcctaaaagcttttatttcttactttacctgaatttggaaatgggattttgtcaacaatgcatttatatttggggacgataaatgaacattacagagggccatcataaataaaatcaggatagcaatatacctttttaaaagagttacaacctttatatcaagacagtcattgtttgtcttaaccaaaataagtcaaaaataacagctataaaaattattttctttattcctaaatataaagaaaactgactttttgtttaa

SEQ ID NO: 17323 - DNA, 684 bp, Homo sapiens
  ENST00000480743
ataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtaagatttcatcatattatattttaatacacctctaaaaatatgcaaatttataagactctgtaaaagtactaaaacaattaaaataaaacctgattatagtagacttgaaataatattaaataaggtcctcccctcttatccttgggtcatccattccaagatcccccggggatgactgaaacctcagatagtaccaaaccaaattaccatcatttggaacatgtttctgttcatgtcttccattcacaaatataataccttttctatcttaactaagcacttaagcccacacagtaac

SEQ ID NO: 17324 - DNA, 438 bp, Homo sapiens
  ENST00000367632
gccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatga

SEQ ID NO: 17325 - DNA, 524 bp, Homo sapiens
  ENST00000478871
ataattacattttatttaagtacctacttgatgactattgtagacaaaagctcttatgtgttcttttcttcgttattatagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaa

SEQ ID NO: 17326 - DNA, 7512 bp, Homo sapiens
  ENST00000367634
gcgcgcgcgcgcggctccgccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaagtggtattctgttttttctaagctttgagatacaaatattgctatttaatcacattgatgatgaattactttccatgtgaaccttctcaaaatgatttaagtacctttgattttgctcccctaaaaatggcttgtgtctaaagtgacatttttttccctatttggagggttctaatgaaagagatccaggcataaaaactcttttgcttattgaaagcaatttgattacacctatgtttcaggttatagtggggagaaaatttggtcagtgccttattatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctctgtaggtgattgttgcagtcttccttggtttttgagtctttttaaacaagctcctaccctgcttctatccttttagagtaggagattaaaaataaacccaccccagtcaacctttagataagcactcttaaaaacaaatttgaagagcactcttcagccaagttcatttttattttgttgttgatgttttgagcatacatttaattgtaaggccttttggaaaagccctaaaagaataagatacaaccagaaatatttgagttttgttaaatgtactgaaatcttgtaatgaaaatccctttggccagaaatgagatttatttccatttatttttacatttaagtaacactcaaaacaaacaagtagtcacttaacctgccagttattattttcttgaaaatatacaagaaagtaaaaatatctctaatatataagttaaaggaaagttaagagactaagctagttttttcagtgaaagcaaagttggaaatattttgcttctctcagattattggaagacctagagctactggatgttaacctgaatcaagatgttcttttcacatttttttaaagggctagtatgttccagagtaggcaagtagtcattcaagccaaatgaaagagttaactggtccttgaggagtgttagcaaaatttaaattttgaccctggccatttgtactacagaagtgattatgggattaaaagaatacataattacagtgttttgggattgggctcttttttttcttaatagaaaagcagaaacttcataaataatagctgtgctttagataccagataacaaatattgtttcccctgaagatatgacctactagaactactcacatatatagtccaataattactgacttaataggtatggtaaaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattat

SEQ ID NO: 17327 - DNA, 595 bp, Homo sapiens
  ENST00000522613
agatctagggaggagggaacagcagaggcaaaggcagcttgggagggatgggaaatggaaaatcagggaaacaaacaaacaaacaaacaaaatgaatgagtgaatgtgggcttgaatagtaaaacttccagagagaagacgatgggatctctccccaggtaactacctgtagatgaaaaatagatgaaatacacaaggaagtggcaagcaacaactttgagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttg

SEQ ID NO: 17328 - DNA, 2168 bp, Homo sapiens
  ENST00000522455
tgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 17329 - DNA, 1924 bp, Homo sapiens
  ENST00000521695
acagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 17330 - DNA, 2701 bp, Homo sapiens
  ENST00000521268
cgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 17331 - DNA, 2682 bp, Homo sapiens
  ENST00000518566
tttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 17332 - DNA, 571 bp, Homo sapiens
  ENST00000517988
aaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcagatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccc

SEQ ID NO: 17333 - DNA, 1972 bp, Homo sapiens
  ENST00000517638
ggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaaa

SEQ ID NO: 17334 - DNA, 459 bp, Homo sapiens
  ENST00000522647
agagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaat

SEQ ID NO: 17335 - DNA, 1684 bp, Homo sapiens
  ENST00000523850
agtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaac

SEQ ID NO: 17336 - DNA, 1457 bp, Homo sapiens
  ENST00000521376
cagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttgggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaaa

SEQ ID NO: 17337 - DNA, 1505 bp, Homo sapiens
  ENST00000518065
tttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcaga

SEQ ID NO: 17338 - DNA, 857 bp, Homo sapiens
  ENST00000404910
gcagctgccagagtgccaccaaagcaaacctcatctcaagactctgtggccaggccctcacaacctcctgccaggctctcgctacctacccatcaacagcaagactcccaggccatctcaatccccccaaagagccctgttcctccagccccacggcttctgttcacctgccgtgctgtccccgcctctgcccacccactcatcctgcagatctggagcagcattccagggcctgcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 17339 - DNA, 910 bp, Homo sapiens
  ENST00000254661
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaa

SEQ ID NO: 17340 - DNA, 734 bp, Homo sapiens
  ENST00000409726
agtcctcagcggggcgcgtggcgagcggactcgactcggcaccgctgtgcaccatggcccgggccctgtgccgcctcccgcggcgcggcctctggctgctcctgggcaggatagcctgaggcacgcttgcttcactcccaggcagaatggccactgagaaatccggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctgg

SEQ ID NO: 17341 - DNA, 650 bp, Homo sapiens
  ENST00000403885
ggagagcgggcattctggaaagcgtgggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 17342 - DNA, 113 bp, Homo sapiens
  ENST00000591972
atcatcagatcgtgggactatctcctatggctacatggaaaagaaagctgtcctgaatccccacgaggccctggctcagcctcttcccaccacaggcacaccagggtcagaag

SEQ ID NO: 17343 - DNA, 858 bp, Homo sapiens
  ENST00000589683
cccaggacagccccttagaagcagcggcgtcgagaggccgctggagctcccagccccctccctcttctccacgtctgggagagcagcttgccgacccctccagacccgaaagagagagggggcgactcgaattcggggagcgatcctgggagaccctggagagtcctgggcgccacgcagccgagcccccgaaatagatcccggttccggggttccgggagctgtccagcctcgcgggctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttgtacaa

SEQ ID NO: 17344 - DNA, 548 bp, Homo sapiens
  ENST00000588928
cgagaggccgctggagctcccagccccctccctcttctccacgtctgggagagcagcttgccgacccctccagacccgaaagagagagggggcgactcgaattcggggagcgatcctgggagaccctggagagtcctgggcgccacgcagccgagcccccgaaatagatcccggttccggggttccgggagctgtccagcctcgcggggtgagctacgagagggtgggccaacgccggcgaggcggagggagccgcgggcgccaggcgcggctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcacca

SEQ ID NO: 17345 - DNA, 780 bp, Homo sapiens
  ENST00000253796
ggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttg

SEQ ID NO: 17346 - DNA, 549 bp, Homo sapiens
  ENST00000587142
cacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaagcatctgtacctacaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctaggg

SEQ ID NO: 17347 - DNA, 573 bp, Homo sapiens
  ENST00000588576
cacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaa

SEQ ID NO: 17348 - DNA, 11711 bp, Homo sapiens
  ENST00000283195
cacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcagtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaggactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaca

SEQ ID NO: 17349 - DNA, 367 bp, Homo sapiens
  ENST00000425282
gctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaacgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtga

SEQ ID NO: 17350 - DNA, 646 bp, Homo sapiens
  ENST00000495924
gctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggtaaacaaacaaaacataaagggagaaaacttaagacataaccatttctaatatttggaatttaaattacttttcaatagcaaaccttaagcccaggtgttagtgtttcctttaaaaattttcttttaaaaagtgtgttaaaacctttctgagcatctactgtcttattaggcattgttatactttataagtgacatctcatttacctttctggaataattaatattttagggattttacagtttagtagctgtaaactaagtagagctaagatttacattaagttccgtctggtatacaatttttgcttcattaagtgaaaattacctacaggatgacaatttagggatattttaaagaagtgttttctaataactattgtctgaaagtagaagggattgcattttgagatagtaaggttttc

SEQ ID NO: 17351 - DNA, 544 bp, Homo sapiens
  ENST00000495506
taccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagccctgaactgtgtatttagaaagcaattttagtaaattgaactattttttagacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaaga

SEQ ID NO: 17352 - DNA, 156 bp, Homo sapiens
  ENST00000629728
atgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaacgttcagtggaattaa

SEQ ID NO: 17353 - DNA, 3104 bp, Homo sapiens
  ENST00000296604
acagagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattataaattgctagatttgataaatacctaacaaaatgtttatttttttcagtcatacttgaccacaaaacaaatattttactaaatttccagagtcatttctctgaaaaatagtataatggcatgataacatttcactaaatcctatttatcttctgggaaatattttaatttagcttttggatttcctaatatgataagcttatatattcatggtatgaattcctttaaaaagagcatctgctcttggacttgtatctgttgcatcttgtcaatgtttgactcatggtcagcatccaatagttgttaaatgaataaataaaatataatacattacctatgtatcaaaaagcatgtgtaagaaagccaaatatgttaactgttctactttatttatgtaattatattttcattagtattttagtagatggggctgtatagaaaaacaaatgtatcatatgtagccaaatgaatctttttcttaaatgatattattatagtaggctacagtaatttcaacaattttacaatagagttttgatcctcttctttgcgatttgtttcagagacacctcatgaatcacacaagaaaattagtctcagtacttatagccctatttcatttttcaattcagttttatcacaccatggcttcgaagtgactttgattgtgacccctaagcaattatctgattaggggataaaaattcataattccaagatgtttctgaaaatgttctgaacaatgacaacatatttggaatgagggcgtaatttcactaagtgatgcttcgaagaacaatattcatttggatatgcaaacacacattttcaaaagttatattactgtgttaccatacctgttataaaataataaaaatatataagtatttattaagtcaaa

SEQ ID NO: 17354 - DNA, 2278 bp, Homo sapiens
  ENST00000502994
agagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgtcaaccttgtctcagaagcaaatgagatgttcatccgtcactaacctcccaaccttcccccattctgggccagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattata

SEQ ID NO: 17355 - DNA, 1532 bp, Homo sapiens
  ENST00000515759
agagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaaggtctgtatatcatgttttactctttctggtagcatttacatacttggaataaagttaacatgagaagaggcatctttaaaaatacagacagaagtatagttttcatggagactaagttgcttaaataaaaatgttggatgctctc

SEQ ID NO: 17356 - DNA, 572 bp, Homo sapiens
  ENST00000505865
agcttgcattttaattacaaacaaagtagcagaaatcaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaa

SEQ ID NO: 17357 - DNA, 6061 bp, Homo sapiens
  ENST00000449771
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttgaatggtgttttcatcttctttcatcttcaccctgtctcacgttacgttatttttatcctgatgacagaataggtactacaggtatttttactctggttttacagtcaaagaaactgaggcacaggcaggtttgcccaaggtcacataactgcttaatagcagggtagacaggtgaagtaactggatgtgtatcagccatgccctttccccatgcccccggcactccccatgacagctctctgaatcccaacattttattcttttgcaggattagacccaagcatataaattcctttttccctctc

SEQ ID NO: 17358 - DNA, 2659 bp, Homo sapiens
  ENST00000547856
gagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggcccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccag

SEQ ID NO: 17359 - DNA, 3265 bp, Homo sapiens
  ENST00000549151
aggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttcc

SEQ ID NO: 17360 - DNA, 2325 bp, Homo sapiens
  ENST00000395360
cactgctggtagttttgggaatcacccatgtgcaggcgacacatgaggcagtaaggaactctgcaggggtccctgagatttggaaatgtagggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaaggcgcattgtgaatatttagatcctcagaataatgcctggcttgtagcaaatggtagctggaggaaaaggaagagaaaaccaaagtcagcagctgaaggattttcatattagaactgctctggacctatctggcagatgcagaagcacacacacacggaggggcatggatttgccccgcccttagacatgttgtgtcttctcctggatccttggtcccaggtgccttacctgagctcaggtgaatgtggcaagcagagccctctggtggtgtgaatgctgtgtggcgcccgtgctcctggtgacacagggacctcacaatccctccctccacggtctcctctcatgtcctcccagccttattttctcgttcctcttcctcccaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacca

SEQ ID NO: 17361 - DNA, 3395 bp, Homo sapiens
  ENST00000482843
acgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatggagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccagcctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacca

SEQ ID NO: 17362 - DNA, 3917 bp, Homo sapiens
  ENST00000479866
gtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggtgctgctgctggggttggggagggcaggggccattcgtccagagaagtgatgtggagagaggagtagggaccagagcagagggcctgtaagaagcagggcaggtaagagatgctgggctatgacagctggcagtgggaccatagccctgggtgtgtgtgagaaggtgaagcccataaggcacagaaggagttcagtgagaccagtgacttcaggctcagtgtgggagaccaggggaaggatgggcatgcagggggcgggggactaggctgtgggggaggcaggatgcatggaaggtagggaaggctgaggaggtggagccaaagtcggaggtgggagaagggctgtgggtccctgtgggaccctcatggggctcaggggctggaatgaaggaggtagatgagagggtctaaagctggaacatcatgagttgagcatgggatgtggcctgttctccaggatgtggaggcaaagaccatgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatggagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccagcctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacca

SEQ ID NO: 17363 - DNA, 1947 bp, Homo sapiens
  ENST00000488250
aataaccaacatttaattaaaacccacaccccactgtgtgaatatttgtttgtaagtaatacacatatattactacattaatatcataataaagatagataaaatagaaattgatggagtagaaatgcaaagcaggtagaaaaagtaaacgtaagtagaagagctcatattttccccaggcacatggatgatctgatgtaccttactttggaggccactgctctagggactggggactcaagcacagtcccagtccatgaggagctgatgaaaatcaacaccaaggcttatataagacacttcccaattttcaaagggcttttatacatagcatgtacttatagctactatttatatacattattttatttgacttatgaaatagttggggcaagtcttattgtctccattttaccagggaagaaagtgaggctgagggaggctcagaccctgcccaggttcttcctgactcactgagaatctttcctcatcctcttggatgtgcttccctgggctgcgtggctgcgtgggcacatgcacctgtgtattctgagcaccacccaggacttcaaccccgctactaggagaaacaacctctcagcctcccaaacagcacctccaccctggcatccagctggtccccggcctccctcccttcccccacccagtccgcctctgctgtctttgcagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacc

SEQ ID NO: 17364 - DNA, 3294 bp, Homo sapiens
  ENST00000389212
gtgccagctggctccttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacc

SEQ ID NO: 17365 - DNA, 2776 bp, Homo sapiens
  ENST00000548919
tcctttaggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagca

SEQ ID NO: 17366 - DNA, 699 bp, Homo sapiens
  ENST00000490387
ccagtagaagaggcgaggatagagttgggggtggaacctcccacctccaggaacttttgaggattttgagggttttgactattctggagagaagcagagaagaggtacttcatcagcatagcctgggagctcttgagagaaaatccacctcgtggggctcaagggattcaaaggagtttactctgcagagagagagagggagggacacagaaagagacagggatagaaagggacagagaggtgacagtgacagacttttccaagaaacctggggcccctgtgactaactgctgtgaattttctcagtgctaatgggaggttggaagccccgtgttcgcctgtgacagagcctgggtgagacctggggctgaggagaggctgagttggggcctctgcacctgctgtgggatgggcatgtggcccctccttggttgggtggggtctgtggtggcttatggtgtgtgcaaccccctcagtgtggcttcttcccctaggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaacc

SEQ ID NO: 17367 - DNA, 695 bp, Homo sapiens
  ENST00000548434
atgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctgtgctaatgggaggttggaagccccgtgttcgcctgtgacagagcctgggatccctcatggaaccaccgggtataccgactggccctcgccaagctctcccctcctgtcatccccttcatgccccttcttctcaaagacatgaccttc

SEQ ID NO: 17368 - DNA, 726 bp, Homo sapiens
  ENST00000473777
gtcttattgtctccattttaccagggaagaaagtgaggctgagggaggctcagaccctgcccaggttcttcctgactcactgagaatctttcctcatcctcttggatgtgcttccctgggctgcgtggctgcgtgggcacatgcacctgtgtattctgagcaccacccaggacttcaaccccgctactaggagaaacaacctctcagcctcccaaacagcacctccaccctggcatccagctggtccccggcctccctcccttcccccacccagtccgcctctgctgtctttgcagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccagcctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatcc

SEQ ID NO: 17369 - DNA, 824 bp, Homo sapiens
  ENST00000476259
cctcaaggagcagaagaatctcaattccttctttgccgtcatgtttggcctcagcaactcggccatcagccgcctagcccacacctgggagcggctgcctcacaaagtccggaagctgtactccgccctcgagaggctgctggtgagtgctccaccctgcccggcctggctctgctaggatcagctgggctcggccctgccctccagacaccctcactcttggcttccctgcagcccctctactcgtcctttgtcactttcagggttcccaacctcggcccagggcctagctccagcctgtgagtttggggagctggctgaggaaggggtgttcagcactaggataggggttgcacggtgcatcctggccctcagtgtgtgcatgggggcaggagatcctgtgtgaagactgggctggagcatgtgggtgtccagtcctggggtctgaggtgccagggcagtgtcaggggctccagagcccaagggcctggcatggagcgcctgtgtgcaccagggcctgtctgcccctcaggaactccgaggggcttgcgggctagaccagtagaagaggcgaggatagagttgggggtggaacctcccacctccaggaacttttgaggattttgagggttttgactattctggagagaagcagagaagaggtacttcatcagcatagcctgggagctcttgagagaaaatccacctcgtggggctcaagggattcaaaggagtttactctgcagagagagagagggagggacacagaaagagacagggatagaaagggacagagaggtgacagtgacagacttttccaagaa

SEQ ID NO: 17370 - DNA, 4092 bp, Homo sapiens
  ENST00000395358
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggtgtctgcctggccccagtttctttcctctgctcctcctggactgcaggcccctccttcgccccctgaccctgaggggctctgtgggcgtgggaagctctcctcccacagacacacccttgggtctctgataggtgttcacggggcccttgctgcatgtggtgccctgggccaggccgtgccaggaggcgcagaggcctaaggtggcctccctcctcgcccactccctgactcaatgggccttttattccttttgggaggtaattcatgcccacaggtagagcctgggagatgaggaatggtggctggagttggcccctgaggcccacggggctcctggtggccagtgctgtgggagctcagaggaaggcgaggcccctccctggaaagtcagagggggccccaggccattctcagctggggcttaaagggaagcaaagaggggatgagaagatgtgactgcagccaggatttggttgaggaatggtgggagaaagaactggaaaggtagattaggttggtggtggggagggctgcactgggaataaaatccaggggcctcaccatccagcaggctccccatggtcccaccctactgtgtgtcccagcccctgcctgctggagactcttactggcttcttctcctccgcaggcgaagcccgttctcccctcagggcctttgcacttatcccttagcctggaagggtctttctctggctctgcctggcaggatccttctcgttctcatctcagccaaatgctgggttcccagacaggccccctcccgtctccctatccggagcaccctcccctttctcccaccacgctctgccttggtgtcctctgtgattttcttcaaagcactctcgccatgtggagttgttttctttgcctacttgctttctgtcctttggtatctctcccatcccactggagagttgacttccctcctgcgggcccccacctccgcttctccttgctcacatgctgcctggctcttggctgacgctcagaaactgatgtgggctcaccctcgcaggccgggcactgcgctaggtgctgatgctgcacctcattcaaccctggcctgtggggctgcagtcaggcaaggggcagagcagttcaacaacccgtgatgtgcagtgacacgggacactttccctgaatgtgcactggagtcggctcttccaactgtagtccgctcctgaaaacgggaggggaagagccaactccagtgcagattcagggaaagtgtcccgtgtaagcgactactggagttgagagctgcagggggcaagggtggaggaagaagaggattcctggtgggcaaacccaggaggaaagggaacccaggaggaggatccctggaggagcgagagtaagagtaggaccccagagcaggcaggaggtgggcagggccccctgggccaaggacaggggtctgatctttgtcctaagagcagtgcaaaccattaaaggggtttgagccaaggttggcaaagtctgatttgtgttttgaataggtcagctaaagagcctgggctttctccagcagacaatggacgccactgaagtcgagtgcgggagcttcacagggctctggtcaggcagattggaggaggagggctggaggcacctgggagggaggaggaggagcatagttgggccattggagtagataaggagtgaggcctcgtgggcaggtggaactggagttagcctgggcaggggaggagggggcacagaagacccacttcaaagaagaatcttcaaagcaagatgacaagctacggaagtgtggaggagcctggagctggggagaatggctggggaacagagtggtctgggaggcaggatgcaaggatccgatgggtatatggagtgtgaggtaatggatcattcatgtggaaggatgcagggggtttttgagaccagggtttggaagagagttcagcactgctggtagttttgggaatcacccatgtgcaggcgacacatgaggcagtaaggaactctgcaggggtccctgagatttggaaatgtagggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaa

SEQ ID NO: 17371 - DNA, 783 bp, Homo sapiens
  ENST00000494764
tgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatggagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacaggtgggtggccctgcttggatgttgtggttcccttgactggtgcccaccttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggtg

SEQ ID NO: 17372 - DNA, 910 bp, Homo sapiens
  ENST00000495465
ttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgtccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagctt

SEQ ID NO: 17373 - DNA, 855 bp, Homo sapiens
  ENST00000466322
ggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaacc

SEQ ID NO: 17374 - DNA, 648 bp, Homo sapiens
  ENST00000495953
agtccagaggactctaaggaagtagttctgcctggggcagttgtactgtggcccagccgccccagtcgtgtcccatggctgtccactttcctccccgtgtcacaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccgg

SEQ ID NO: 17375 - DNA, 573 bp, Homo sapiens
  ENST00000549347
gaccagtccagaggactctaaggaagtagttctgcctggggcagttgtactgtggcccagccgccccagtcgtgtcccatggctgtccactttcctccccgtgtcacaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggggcacaggctagcaacatctcagagaagaaagacgctttccagcaagcagccccaccctaatgcctcacagatgagtactagctaacatgtgcatacaactatatgccaggcaatgctttaaacattcgatgtgtagcaactcatttaattctcccaaaacctcatgagtcggtattattagtgctttgtagattttacagttcaggagactcaggtagggagggagaggttaaatcatttgtttcaggtc

SEQ ID NO: 17376 - DNA, 5751 bp, Homo sapiens
  ENST00000405493
gttagtcagggctgaggaggagaggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttg

SEQ ID NO: 17377 - DNA, 547 bp, Homo sapiens
  ENST00000484331
ttgcgcccagcccttcctcaccccgcaggagaagctggcctctcattcctcactgagagactcgacgggcgtccccacgccaagccttcctcgccctcccctccagccttttctgaaggggagacagcaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcct

SEQ ID NO: 17378 - DNA, 4299 bp, Homo sapiens
  ENST00000397081
gggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 17379 - DNA, 3975 bp, Homo sapiens
  ENST00000409036
gcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 17380 - DNA, 980 bp, Homo sapiens
  ENST00000464976
tttcctatgtccttttccacatctaaccagtcactaattgtcttgacttttattccacttttatttcagggccttagcatctggatctccccgttttctgtttccagtctggaaaacatgatatagtcaaatcagctttgtcttaggatcagccagacctggattcaaattctgtcacctctaccctctagctatgtgatcttggccaagttattaatctttttgaatctttgttttcacatcttcaaatgagattcccagtgcctacagtaatggctatgttgagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggaggtgagccctaaggcttctttgtcaattaatgcagtttcagaaaagaaagggagctgccacatggataatggcattacagtcaagccttaatgtgttctgttctgagctggtagatggaatttaattttcaaaacttgtttttgaaatgagtgagtgaaaaagccattttgacacaagacatccttttttttgtttaatttagtgcttgctcaattttctgtagtttgacataccttataattatttcttgaatgaccatagagtgttttatgtattttctcccttcttttccacagatgtattcttaaccaggga

SEQ ID NO: 17381 - DNA, 4120 bp, Homo sapiens
  ENST00000397087
acagttctgattcttttaaaccaagcggaagcctgcttcgatgacttggacttatgtctgcaccagggtctcattcctgtgtcttcaagcttttccatggagtggcaaaatgattcaaatccagaaaggaagggagtgaagttattaggagctaactaaagttaaaaaaaaaaaaaaaaaaaaaaaaggaagtgttttcttattgccttagactgcctgagctttcctggagaaccatcagcaccagtttcctttctgtggactgagagccactcagtagtagacacgaacagggaatgaacggcaatgaaggtacattttgctgatcaaataaaggatagatgctcactggatgtctgagaactttgagagaccgaaaaagaaggacgtatgctctacaagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 17382 - DNA, 593 bp, Homo sapiens
  ENST00000473003
aatttagattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctg

SEQ ID NO: 17383 - DNA, 1075 bp, Homo sapiens
  ENST00000473043
aatgtcagtatttaaactcctggaccatatgtggcttctcttagcagattttgcaaaggaaacttactccagtatgcaagactaaatatcgacagtatatggcaggacttctggctcctccttatggtgttatggaaacgggctctaacaatgacaggattcctgacaaggagaacgtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaa

SEQ ID NO: 17384 - DNA, 493 bp, Homo sapiens
  ENST00000466030
gtgacttcatgttgaaggtgccaagaacaacttcagctctccagtctctgaggaaatgtttgtttttgtacttacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctg

SEQ ID NO: 17385 - DNA, 599 bp, Homo sapiens
  ENST00000473182
aaacattaactcattcggcacgagactcaggtggagagagtcagtatgtattttgctttgcctccatcttgcactgagattttctgggaccggctcactaggacagtttctgttcctctgattagcttgccagacaatctccccctctagcggccccctggtctcccctggtgctacaagttgtaatgctttcatttaaccagccttgctttaaagttctctcatgagctgagtggcttttttggcttgtattagcatttgagaacctgaagctaccgcgtgtggtgctttgtttgccatgagacctcttctggtaggagatcattaagccctttggtaggttttcctctcaaaagccatctcccatcctctatctgaaaaggggtgacttccccaccctttctgtctcacctctccttagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgat

SEQ ID NO: 17386 - DNA, 560 bp, Homo sapiens
  ENST00000459852
acagtctgggcagggcagagtgagaagggcgaggaggctcccggctttgctgccacttggccctcctgcctgacactctgcatttgtttctagtaaacggagctgtgaggccgaggtgctgcagctgacacgtgcttccatgtttcccatagtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagg

SEQ ID NO: 17387 - DNA, 649 bp, Homo sapiens
  ENST00000397085
ctgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatggtatgtgcagtattataaccttaaccacaatgtgtttttaaaataaaatttgcattttttctaataaaggaaataatttccatatatgctgccctgctaaaaa

SEQ ID NO: 17388 - DNA, 842 bp, Homo sapiens
  ENST00000484645
caaaaatgtgaaggtagaatattttgacttgctgttcagccaataaaatctcatacctcattagtgagtcttatttactgtgaggaacttgataagctaacccttctccacatctaggatagttacagattctcttacaaattcatggcaacctcaagaaaggatggtgaaaaagcactaatgtacagtctcaggcatgatagatgttttttacatcatggggaatatgccaacaattatgagagttatgccattaatattccttacctgaaaatgccttgtatgtatgtgggtacccctttgaaataattaaacaagttatacatcagctagttgccttcagatagtcaacatctcagaacatgtcacttctcatggtaccaagtattgcagaaatggtttgttttcctttttggattgtactctacgcttacttgaatttctatctttcttttttctatattccttttagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgc

SEQ ID NO: 17389 - DNA, 3707 bp, Homo sapiens
  ENST00000535187
aaatgtttgtttttgtacttgtgagttatgcattttatggggcagactgtcgttgctgaatttctttctgctttttattccatctgttcctcaactcttacaaaagctagccataccatctctctctctagcttctgaagtggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 17390 - DNA, 3974 bp, Homo sapiens
  ENST00000540783
aatttagattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 17391 - DNA, 3920 bp, Homo sapiens
  ENST00000538974
aatttagattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacgtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 17392 - DNA, 1273 bp, Homo sapiens
  ENST00000383772
ttggtttaagacctggagtgatgtgttcctgctccagagcacctttctttctgtgaggcccgaaacatgaccaccagcggccacgcatgtccggtcccagcagtgaacggacacatgactcactatccagccacaccctacccgttactctttccacctgtcatcggaggactttccctgcctcccctccatggccttcatggacatccgcctccgagtggatgcagcaccccgtcgccggcaacaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattc

SEQ ID NO: 17393 - DNA, 2775 bp, Homo sapiens
  ENST00000437042
gtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatgcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 17394 - DNA, 3084 bp, Homo sapiens
  ENST00000330688
tctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 17395 - DNA, 574 bp, Homo sapiens
  ENST00000489694
acttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaaggaaagaaaagaaacatgacttcaaaggcaaatacaactaactcatccataaaaaatttctcaaaggaactatggctgttttgaactagcccttccctagatatataacttctttaagtcctctctggatggttgtttacatctgttgtttatacatctaaattgcatgattcatttgtaattgttaacatgttggaataatgttacaggtactccatggcattttatatttggctta

SEQ ID NO: 17396 - DNA, 1191 bp, Homo sapiens
  ENST00000480001
cagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagt

SEQ ID NO: 17397 - DNA, 1258 bp, Homo sapiens
  ENST00000462272
cagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagt

SEQ ID NO: 17398 - DNA, 1235 bp, Homo sapiens
  ENST00000479097
cagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaataattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagt

SEQ ID NO: 17399 - DNA, 2590 bp, Homo sapiens
  ENST00000458646
agacaaacccaaaacatttatgtgcatagaaaaaaattctggaaggtcgtacacagtgaatttctctgagtgaaaagattgtggcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 17400 - DNA, 3817 bp, Homo sapiens
  ENST00000546530
ctagaacgagatggaaggggatgttcaaggcccctcccttgactctgaacggacccccagggaacatgcgaccctctctctggcgacgcctcccacccaccactaatacttgctcctggaccggggggcgcggaggttggagagaggagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccagcaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgagggtatatgaaggcaagaatcagggttatttaacagattccgtaggtcatttggatgagtatcagctttgaggaccacaggcctggggaatgggcaattttattttattttgtttttagagttgggggtctcactctgttgcccaggctgcagtacagtggcatgatcataggtcagtgcaccctcaaacttctggacttcagtgatcctcccacgttagcctccagagcagctgcgactacaggtgcaagccatcacgcctggctaatttttaaatttttgtagagatggggggtctcactatgttgccca

SEQ ID NO: 17401 - DNA, 3382 bp, Homo sapiens
  ENST00000261729
gtgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtcta

SEQ ID NO: 17402 - DNA, 3040 bp, Homo sapiens
  ENST00000446861
ttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctg

SEQ ID NO: 17403 - DNA, 895 bp, Homo sapiens
  ENST00000549444
gttataagtgccaagatgagacgtttgagattccagtggatgcctctgacccagcctcaggatggggactcaaggagggcttcctggaggaggtgctgcttaaatgtgacctgagtagagcagaagttaagcagcggcattggagacagaactgggagatggggccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactcctt

SEQ ID NO: 17404 - DNA, 2502 bp, Homo sapiens
  ENST00000548055
acctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagg

SEQ ID NO: 17405 - DNA, 2733 bp, Homo sapiens
  ENST00000551051
ccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggtttgtggttggggaaagtggaatgtgtgggttagggacccaagcctgggcacctgaggggagaggggatgtgggtccacagcccacgagggtgtgccctcccacccagaccttgacacctgcccccacttctcttggggcggggcaaaggggcccctgactcagaccttcacgtgcccgccttcctgcaggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccag

SEQ ID NO: 17406 - DNA, 2561 bp, Homo sapiens
  ENST00000546727
acctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcagtgagtggtggggaatgaagccaggaaggagtggggcatttggtggtggggcaggagtccccatcagctctcccactcacagaccacttccttcgccctcagaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccagcaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctggagtgcagtggcacgatcttggcttactgcaacctctgcctcctcggttcaagtgatcttcccacctcagcttctggagtagctggatttacaggcgtgagccaccacgaccagctaatttttgcatttttagtagagatgaggtatcaccatgttggccaggctcgtcacaagctcctgacctcaagtgatccgcttacttcggcctcccaaagtgctgggattacaggcatgagccactgtgcccggcaatatgagtcttcttttattgagcactgatttgggagccaggaggggccctaccctctgctgtgaccttggccccggcatccctcgcttctttgctccaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagag

SEQ ID NO: 17407 - DNA, 2472 bp, Homo sapiens
  ENST00000418411
gtgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagtgccaagatgagacgtttgagattccagtggatgcctctgacccagcctcag

SEQ ID NO: 17408 - DNA, 2180 bp, Homo sapiens
  ENST00000548972
ttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctggagtgcagtggcacgatcttggcttactgcaacctctgcctcctcggttcaagtgatcttcccacctcagcttctggagtagctggatttacaggcgtgagccaccacgaccagctaatttttgcatttttagtagagatgaggtatcaccatgttggccaggctcgtcacaagctcctgacctcaagtgatccgcttacttcggcctcccaaagtgctgggattacaggcatgagccactgtgcccggcaatatgagtcttcttttattgagcactgatttgggagccaggaggggccctaccctctgctgtgaccttggccccggcatccctcgcttctttgctccaggctgtgcagagcattggaaacctggg

SEQ ID NO: 17409 - DNA, 582 bp, Homo sapiens
  ENST00000547810
ctgcttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggc

SEQ ID NO: 17410 - DNA, 4378 bp, Homo sapiens
  ENST00000367649
gaagaaggcggctccgaggaggtgggagggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttaccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaat

SEQ ID NO: 17411 - DNA, 718 bp, Homo sapiens
  ENST00000465723
cctgtgtggtggcccagttcctaacaggaaccagggtatggggacccctgttttagagaatcagtttcagggtcccagtaatttccttttcctcaagttttcatactacattttcaagtttttccagatcatctatctaaaaatcacctggaatgcttgttaaaaattcggatccttggacccttccttcacccatctctcaccaatcagaatatctgggagctgcctaggaattgcatttaacaggcacccaggcggaatgcagtggtacagccatggctcattgcagcctcaacctcctgggctcaattgatcctcctgcctcagccttctgagtagctgggactacaggtctttggaatggcatctcttcatatgcaacgtagaatatatgcttactgtattagtccactttgtgttgctgtgaaggaatacctgaggctgggtaatttataaagagaagaagtttaattgtctcagagttcttcaggctgtacaggaaatgtggtgccggcatctgcttctgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaa

SEQ ID NO: 17412 - DNA, 14453 bp, Homo sapiens
  ENST00000462775
cgaaatgagagcaaaaagggagagagcaggaaagcgagcacaggcgagtacagtatacaaagtgttttgagtttctgactggcgtgccggaaagatcatgttagcacacccagaaacttcacacgatgcagaccccagaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttcaagtaggtaaataactttgtttgctgggaggaggtacatggctgaagagaggcaaatagattaagatagcaatgtcttgcacttcctgtttccctcaaaacaacaccacattgtggggcgcaggatagatcagggttgagtggaatttggaattcaggtgaagtgcttgtaaagtgcatgtctagctgacaacagacttgaccattaatgaggacagtgttggtaggagtcagaaaagagcttcatattccccttttatattactgaagcaataagcaatctgagctgaagcagcaaaaagagtcacatttccatcaggtcatcatattccctgagtctctgcagcaaaagccatgtcagaggggagattataactaggtaactataacaagcacttgagcacttaccatgttccaagcactatcaccaaggtactgttggggtttatggcagtctaacggtaagaaaaatgtggtaaaatgaggtaatcatgctgctatagctttttgctttttttcatatagtatcaagttggtcagaattagctttctctgactggtctgcttccgtgtttctctgtgatggtgttaagattatgaaagaaaaagaagattacctaagactgctacaagtgttaactatatgcccttaagaatgagcttgactttggaagtaaagcttttcagatcttagtctacccggggcctttgttgatgggtctgtggttctgtagacccctggctttcactgtgttctcagaggtacaccagattgagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacatttcagactaaagttgctactatatttgacatattgctgtcttctagcatgcacctgggtgactaggacacttgaagagaaacaagaaaggaaatgtatgccggaatattcttctaaaaatatattttaacattaagaacagtctgtcctagaatttcccaacttccatgtaataagatttcaatttaggaaaaataactagcattagcatgtattgtgataaaactgttactttcgaattctgcagaatttgaaatctctttaataacttgtgacaggtaaagaaagtttcatctggtttattaggaaatgtagccccacttagcttcctagaccactaccatcctcttgtaattttccagttagattaatggggtttgttttcaggatttttgatgtttggttcaggttttttattttaatttcttaatagaagttcatttgtcattcccaacatgattgttcccaaatacacccatcttctcctgcatccctgtttcattctgtaaaatccagggatgcaggtttcatgtgtagtcttgttttgtgttagttgtaggtctgtgctttttggcacatgtcgagttcttcctaatcttgttctactagggattaaaaaattaaaatttactcaaaatccagagaagattgcatgaaacagaaactgcatatccaagaattgtgctattttttgttcacttcgaagctgacccatttcagtctaaattgttcgtgacctaatgtaagctttaagacttcctggatctgaaacatcaaaaagagagaaagtgttgatgcggtctttttacttcatggtcctcttagccctaaactatccatccgtataccctttatgcatatccataccctgtaattgtttttagcctccctccagctgcctgactttttttattagcattttaccagtaggaaaatacataaattaattttgttagcaaaaaaaaaaatttaatgacaaagaacactaaaacagatgactaaatcagtggttttcaatcctgattgttcatcagaatcactggagagttgtttaaaaaaaaaaaaaaagaaaaaaaacagaggagtacctcttgagctccaccattgaacaattaaatagaatctctctaaggattgggcctggccaggcttttttttttttttttttctttttaaccttgccaggggattccgaagagccagggggtaagaaacactagtccaaatcaagctgtgagcactgtgcgtagctgtcttaaaatgttttctgtccccaatcctgaaactggggtaagttggttacaggtgtttccttcccttctatttggaatttaaaattctactaaaactgacaatatatactcagccttcccccacatacaccttgtccccaccaatctgtcctttaagtctgtgaggtagaaattctctccattaacatggtcatcccatttatggaatagatacattctgacaaagctgaccagaagatggaattccctatttcgacctcagtttccccactggcttcaatttaaagcagaaggtaggtggcttctggtttggagtcagaagcttcaatgagtacaccccttgaggagtgctgaagggcccaggccagaatcaaatatgctacatttgactttaaagagtaaacaacagtggctcacgcctgtaatcccagcactttgggaggccaaggcaggtggatcacaaggtcaggagatcgagaccatcctggctaacatggtgaaaccccatctctactgaaaatacaaaaaattagccaggcgtggtggcgggcacctgtagtcccagctactcgggaggctgaggcaggagcatggggtgaactcaggaggtggagcttgcagtgagccgcgatcacgccactgcactccagcctgggcgacagagcaagactccgtcttaaaaaaataaaaattaaaaaaaaaagtaaacaacatagagaactcaaaagttcctttgtctacctccaccaccccccaccaaaaaaaaaggcccttaactacatttgactttaaggaataaacataagagaactcagaattcctttgtctctccccacccaaaaaaaaagaaaaggttcttaacttttcttgacctaatattcagcactgaagtcttattacttgaaacttatcagatgctaaattacaccattcatacttattgttctttcaatagcaaaatgtactgaaagctctccagtcccccctccactcctggcaagcatgcagtcacgtgctcgtgtgaattttccaaaatcatgagcattttgtaagattcagttggttatatgaaattacaataaagagtattatatattttattataatttgtaaattgtgtgctatacattctttatatcagtaaaatttatagtaaacacatatacattatatactcacacacacatattactggtctttctagaaacttgattttgtgaaattctagaatgaattcccagggtgatatttgtttggcctatgaataaattgcaatgaactaacaggtaaatgccaatgtttccttgtctgtaaaattaagattgtggctaaatggtgtatagggtactctctagcactgacattctgtggttattatctgatataattgagaaatgtgtccttagactatgttcaaaaatcggcttgaagcttttctctcagtatttaggaacaattcttcctccacagtctcccatggcacagtagtttttaagaaccaaaaaaaataaagtctggaacaaatgtatattcagaacactacagtgataatgttgataataataatagctggccaggcgtagtggctcacgcttataatcccagccctttgggaggctgaggcaggagtattgcttgagcccaagaattggaggttgcagtgagctataatcacaccattgcactccagccaaggtggacaaagcaagaccctgactcaaaaataatagctaatgtttattgagcaccaactatgtgtcagattatttgctaagcactttatatggaatatatcatttaatcataacaccaaccatgtgagttaggcattattattatcattcttatttcaggaggaaactgaggctcagaaagactaagttacttgcccaaagctacacaatggataagggcaaaactaagacccacgctcagatccctctgaccgtgctgtcttgaccaaaaaaaaacaaaaaaacaaaaaaacaacaaaaaaaaaaacttaggaaagacattggagagggtaagaaaagatccaaaaagatcttgccacataaccaacttgtcaccatgagccaaagtgatggcagtggaacaagatgaggtcatattccacaggttttccaccttaatatattggtttttataagattgtcttgcaatgtccaatcatctgatcagaattagaagagtgtgcagaagtctcacctgtctcagaaattggtctttcatctcttctgggtccatcagagttgagatggtaaagtctgctttcaagattccaaaagggtgccctgaaaaagaaagtgctacctgttcagggggatattatcctatttccatttcaagttcttagcagtcaggagcacccggtggacaccatagatgctacatgttgatttgggatttcaagaagaagaaagaaactgctgagcagaagaatgctcagccacaattagggttaaccaattagtggctgaaaaaaagagtcccatgctttgggtaatgcgaagtcttccacagcctggctacccatcaggcaattattttcttttttgtttcttctgtatttttctccttacttttaatccagtaagtagatactccacaccatgccggaaatactcatctctccttgagctccccaccacagaaaattctaaagaagttctctgactttttaaataaatccagcctttgcccgtgagccatccataatcattacaggaactacaatctcataataagactatatttgcattgcattttattgtttataaagtttatagttatctcattgggtgctcacaacaacgctgtgatataggcagggtagtttttaccacatccccttcacagaagagaaatagaaattcagaaacttgtcccctaagttttcataatagtcatggagcataaactagaatccacctctttattactatccctattcccaacatttcatgctgtctttcatgaaaaggtctcaagggccctgtgccaaggagtgactgtccagatttaactgctccactggtaagagtaggaacttggtagacagaagcagttacctgatttttgtgctgatgttttttctttagattctgaactcagatgttgggcctccgtggcagcagctgtatctcttctatcagtgccactccctacactggccacagctacaggaggggaaaataaaagatttattgcaaatacaaccaggagtaaggtggcctgatattggtgactgcccctgagctaaaagacaggcaaggacagccactgctaggcacacagttgctgcagaagccagcgatgtgggaagctcaattcctgccaatccctgactcacccctacaggctcttttaacccagcacttgagttgctacaccatcatctttcagaaagcccccctggcagcaggacctgtggggcttgggcaatgttaggaggtttttcctcatcaaattttttttgttcagtagcctgtgctccaaagggcctaatgtccttattttgtctgccagctacacaaagcccccaccatggcacccagggaccctcaatatcgccatctccatcccaaaccaagttcaggctctcccccagcaccccctctcttcctgtatggctggccatgcccggaggcgctccagccagagaccctggtgtcctcagcggctcccttgctccatctcacctgctctcatgttcagtcaccaaagtcctgtcagtgccttgcagatgtcttattttttcaaatatggaaataatccttttatttggaatatattattgtaaaatatgtaagcaaatttgtcccctccccaacccagggacacccatgattaacactttgctgtagaaggtccttcacactctcgaatttgttaatttgaatgtgtaaagatctcccttgttctctttaaaggctgcatagtagtatttcactgaatgtaccataacttatttaaccgatctgctttcagtggacattacgttgtttccaccttttcactgtaataaacaatgccgcaacaaac

SEQ ID NO: 17413 - DNA, 2385 bp, Homo sapiens
  ENST00000433130
agaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggtcataaatggagatgagattattcaaacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagatt

SEQ ID NO: 17414 - DNA, 650 bp, Homo sapiens
  ENST00000463079
ctgatttcgatttcctttctttcctcgatgtctgccgcaccttgtttcgcctcctccattcatctcgacgccatggttctgctgctccataacaatgcattatgaacctgccactcccatatgcaaacacttacccttccctccaacctacacccctccatcaatggccatcgttgtgccaaaaacaatctgtggtggatgtcgcaatgcttattatccaattagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctat

SEQ ID NO: 17415 - DNA, 3016 bp, Homo sapiens
  ENST00000509081
gtttatttttgttgtcagtgccatgtaatctaaagtctgactcgtaggaagggacaagggaacagaagtcacatactcgccaccgacaaggtgatgtgctgtcatccttcggtgttcacctggcaaacttgggagacactgagtcgccttgcttttgccagagctcagttgagtcgcctcgggtcacctgcctggggaatctcagatgagctagaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactagaaagaaaataaaaagcagagtttgtcattggactgcttaacatgctagaaggactttttttttttttttttttttttttttttgctcttctgagctgtttacaactgaccactgtgttccacagatgtatttttcaatagctttttgttacttagttttccatgatgcctgttatttttctcttgtaaatttaaatgagctgactttaaggatcttgggaaaacccatggcataattacaattttctttttaatcgacttttcattacttttgggagtctgttggtaactaaagatgtcaacaaagaataaattggagaagttacctgtccccactatagcagtaaacaaaacagatgaaaaacaccttgctgttaactcaatggttgatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatattttacactctgcggccagga

SEQ ID NO: 17416 - DNA, 2277 bp, Homo sapiens
  ENST00000264400
gtagtttcagtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 17417 - DNA, 2386 bp, Homo sapiens
  ENST00000638048
atggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggaacagcaatggaaaccttccatgtacagcagcataactccagtttgctttccaagccctctgattgagaagccaataggcaaagaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 17418 - DNA, 1756 bp, Homo sapiens
  ENST00000335927
ataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagataaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatgga

SEQ ID NO: 17419 - DNA, 860 bp, Homo sapiens
  ENST00000504863
agtataaacaaggaacccgactggttagacagattttgtttttcttcttcccgcgcgctttagctccctgtcctttggtcgcatttgtgggcgcgcggcacgcagccgggaggccgaggactcggagttcacctgcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttg

SEQ ID NO: 17420 - DNA, 6323 bp, Homo sapiens
  ENST00000436139
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactggccttggcctcccaaagtgctggaattacaggtgtgagtcactgcacccagccgcaattttttgtgagaaaaggggaagtatattaattgttgagggaattaagtgaaaaatttaaaaaccttcatctgaagaactttggggctatgttcatgtcagctcatgcacaggatttatgttgcaagtgtgttttaattttactttacttatacctttttacttccaaaaaggtttgacacagctagttagatgataataagtggcatcttaatagatataaacattttaatgccatttatcccaattttacaaaatcagactaaaattatgtaaggctagcttttgaaaaatttgtatgggctttcctgtattatgttctcatgaaaatgggattaaccattttactgttactttttgacattatattatgatgaacccaagtgctcgagacagccattatttctgccgggccgaatgagtcatttcctgagtcactgtgcaagttatgacggttataatcattttgccagtttgcctcttacaggttctagccaggtatgaattgataggtcccttgcttacaaaggcaaaagttaagcatcatggtgcagttttgtagtaaatcttatgttagaggggttagccgtggagttccttggcagggtcagtgctggctcagtgaccttggtttatgtatctgaagctgctcaaaagatcagtgacatcataagggctttttcttgtatgaaggctgagacctaagtcaaacagttttcatttcagtttggttgtctttagctacttaacattatatgtcagtcatcttatcttccctctattgcctttataacttagttctttccaaaagaaacaccttaaaaatctttttcttttaagataaaatgttggcattttgaaaataccaaatggatggtccttgttgttgcggcagtcaaaggggagatcatttttatttgtgtttacctgatgagaattggtctttttgtttaacagaatcaagccattcgagagctgggtagaacagagagaagggccaaacagccttgtgaccctggcttcttttcaacactcctgggttaataacatattcttgatagaaaccttgcgaagttcagatggttttgagcatgaaaagaggagataagaagacaagccagttctaactgaggaattgattaaactaagggttgagtggagagatgtcacctgccttgatcgggttgggtttcacagggagatgttgtttctttagctgcttctattcagtattcagaattcaaatccacacttgccagctggtttatctgagtgtgttttggctagtcctctaaatccttgctcctttctcatctctataaatcacagaagtaactgccttgtgttaatgccctttcagctctgaaactgtgtgatcgatgtccttcctccagttctttggcttcaggctccttatcagtcacgtgcttaggtggctctcctcagagagaccttcccttggcacccaactatgatcataccccctcccattatgggctttcactgctcttcccttcatagtcattcttagcactctgtgatgagtaatgatagctggccctctctctgtatttgtgggatctgcatccatgggttcaaccaacctcagattgaaaatattcaaaaaatattaagtctgtactgaacacatatagactttttttccttgtcattattccctaaacaatacagtatcacagtgatttacatagcatttacgttgcgttagctattataagtaatgtagagatgatttaaagtatacaggaggatgtgcggatgttgtatgaaaatactgtaccatcttagagcggagacttgaccatctgcagattttagaatcccagggaagtcctggaaccaatctcccgaggatactgagggatgactgtacttgcatttttattgcttgttttcccctctagaccccatgctgtgccctctttgttcaccacggcatccttaactcctagctcagtacctggcacctagtattctctcagtagtgtttgaatgaatgagtcaatcaatgaatgaatgaacaaatgaattactggaatagggaaaaattatttccctctattggaaggaatatgggtctgggttgggatttgttgcttcttgcctgggacttttttttttttttttctccttttggcagtcagtgaatccaggtgtgccgtatatataatttagtcaggttcttctgaatctaccaggacagttctacataatttggcataatatgtttctcccctggggatttgcccaaaatgaagtggtttattaggacttgcctgcaagaaacatgaaatgaaactaatgattgaattacatgacaaatgactgtagtgagtagaatgcaattttctcttccttaaggggctggtctttataataagagcttctatctttatttgccaggtaattactgtcactggcatttgaagttataaaaaagaataagtacatatttagtaattcatgactcagtgaggaaccatgcttaacaacacaaagcttgatttctcaaatggaatcaactggcagcaggaaacttttaaaagaggtcatatacatacactctctcacatgctcacacactagttgttgttgaatagctttcccccatactctattgcatacatttttcccttatattttgatgcagttttttgctaacaacctgattatacattcctctgcctcttcccccagtaaatttttctaaaattgcggaataggctgggtgcggtggctcatgcctgtaatcccagcactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggta

SEQ ID NO: 17421 - DNA, 648 bp, Homo sapiens
  ENST00000514889
tcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagtaaatttttctaaaattgcggaataggctgggtgcggtggctcatgcctgtaatcccagcactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatcc

SEQ ID NO: 17422 - DNA, 691 bp, Homo sapiens
  ENST00000507538
ggcggcggctgccgtagtttcagtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatgtaggtattcatgtttctctgaaacacatccttggcaatgagtagaaattgcagtacagtaggcagggaccatagataatacagaattatatctaggttgctaagaatttttctaacaagaaattgcatattgattatcaagtgcattgaaatcaaatcgagcctggataaggatcagattttggtatactatgtgtatcaatttcttttcaggttagttacaacattgtagatggtctgataccatctaaatgaagtatctgtagagttgattcatgcatatagcttagtccttaaatagaaatgtcagagaacattggatgctcccagaatatgtaatgcctttttt

SEQ ID NO: 17423 - DNA, 516 bp, Homo sapiens
  ENST00000512716
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaagataattgaaccagggcacaaggagacttttgtacttgttcaggtcacacagtaagtgatggagccaggattacaacctgcccttccttacaacctgctcttccttacaacctctgacaccatattctgaaagaggaaagtatgcctcagactcctcccttttcagcaatg

SEQ ID NO: 17424 - DNA, 537 bp, Homo sapiens
  ENST00000514050
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggaacagcaatggaaaccttccatgtacagcagcataactccagtttgctttccaagccctctgattgagaagccaataggcaaagtaagaatgaacctacttttatcagacactatgattcgagccagttggctgttatttctttttgccttgagctatttcggtgaaataataaaattgatcttataaaa

SEQ ID NO: 17425 - DNA, 498 bp, Homo sapiens
  ENST00000512343
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaagaggctgtgttccctgccacgtggggtgagccaatgggctgaagaagcatgaggaaaaggagactcgggtatggcaggtggctgtgtggagaggacacttggaacagcaatggaaaccttccatgtacagcagcataactccagtttgctttc

SEQ ID NO: 17426 - DNA, 539 bp, Homo sapiens
  ENST00000510780
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagtttatgtattcatcctcctgtagcttcctgagaagtcatgggagaccaccattttcagcacattggccagtgagaagtccttatctgactgcaaaaagaggctgtgttccctgccacgtggggtgagccaatgggctgaagaagcatgaggaaaaggagactcgggtatggcaggtggctgtgtggagaggacacttggaacagcaatggaaaccttccatgtacagcagcataactccagtttgct

SEQ ID NO: 17427 - DNA, 504 bp, Homo sapiens
  ENST00000508294
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaagcatactcagaccagaccctggaacggagcaggtttttgatgaatgcctgttgaatgatgaataaacggatgaagggaaccaagaggctgtgttccctgccacgtggggtgagccaatgggctgaagaagcatgaggaaaaggagactcgggtatggca

SEQ ID NO: 17428 - DNA, 3485 bp, Homo sapiens
  ENST00000613784
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggt

SEQ ID NO: 17429 - DNA, 6237 bp, Homo sapiens
  ENST00000558480
cggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 17430 - DNA, 6294 bp, Homo sapiens
  ENST00000419573
cagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagaggaccagggaggggaccagggaagcagaaatgagcaggtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 17431 - DNA, 2850 bp, Homo sapiens
  ENST00000394745
ggagccctttttggcctacttggggtgagtcaacataaggagtgcaggccaccttagcctttgcttctcaaaagtcatggggcaatgaaggacttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaagcaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtc

SEQ ID NO: 17432 - DNA, 348 bp, Homo sapiens
  ENST00000559926
gggagctgccccctccgtgcattcaccaacttgtccgtccgtccgcccccggggcaccactccatccacctcctcacatggctggcttcctcgtctgccgccgccaccaccgctgcctccactgcctctggggccccccattctgtctgagtccccaccctgaccgtcttccctctttcaggtggcctgtgggcccgtttgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtt

SEQ ID NO: 17433 - DNA, 4187 bp, Homo sapiens
  ENST00000560334
ctgattatcacaaacaaggaatctgtgcctagctgatgtggcagcaggcactttgcaaaacagctagattgattgcaagagtcgttgttggtcccatggacactctggtaattggagatgtcttcttcttgatacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaaatgttgcacccatctgtgctgtccagccgtctctcttctgcctgggctcccgagagcccctgtggactgtgcttgtggggagctgccccctccgtgcattcaccaacttgtccgtccgtccgcccccggggcaccactccatccacctcctcacatggctggcttcctcgtctgccgccgccaccaccgctgcctccactgcctctggggccccccattctgtctgagtccccaccctgaccgtcttccctctttcaggtggcctgtgggcccgtgtaagtgtctctcccacattcccctgctccctgcagcacagggcagaggtggcctgcgggcctctggaagctaagagctttatgcaaaccaggttctggacttgcagagacataggcagggcacacagaggagggagggactggggaaacctggggcaaatgcttcccgcaccccctctcctgaggctctaaggttttcacaaagagcggtgttgcatgaatactgagcgtctgtttcactaggcaggggacgggggcaagagtagcgaggtggcagtccatgggcatagccaatgacctccccagagaaggagtcctgctatgggcctcaccatgttggtctgcagcccattcatacgtcccaggcatctttttttagcttttcattaagatatccaattcgggctaggcacagtggctcatgcctataatcccagcactttaggaggccgaggtgggcagatcacttgaggtcaggagctagaaaccaaccttgccaacatggcaaaaccctgtctctactgaaaatacaaaaattagccaggcgt

SEQ ID NO: 17434 - DNA, 1521 bp, Homo sapiens
  ENST00000623620
cttgaagagcacacacagatctcttcctgtcagaatggagacttagattgtccttctcagtagacaaatttctcagcagaaatctgaccccaagattgggcgtgtgcttggcctccggggcctgtgtcccctccaggctgactagggctctggtggcgtgacgtaccgctgtgctcccgcggtttctcagccacattctgaatcttgaggaacagagctgcaaaggaagtctctaacctatctcaccattttatcaatgagggagctgaggacccctgagggaaagggccttccctcgggctacacagggaaaggtgcacaaagccaggcttgacccggggtgctccatgggtcagacaaactccagccaccgaaactctgctccagcctgatgtgtgcgctgggcctggcgaggtcgcttggcaaagccctttgctgtggagcttcctcttctccagccaggccttttcttttctgatgatcagttcgtctcccatcttttttcttgatccttaaatttgggtggcatttctggtgtgaaaaggggaacgtgtgaaatgacggtcacatcctttgggtctagttcatgagaaagatcaggaaaatgaaaaatctgccatttcctgctctgagcgcaggctcctgggagtcacccactaagtccttctaaactgcccaggtctcgggatcctgcagcatttccaagggccaaatccacactcaggtccctcacacccacttccttgcttctgagagatgtgggagcacaggcacactcaacaaggacccgtgcccaactcctgaggagttcaggggcaaggtgcccaaacacaggaggcccccagatcccaagggaaggcaattctggagccctgttgggcagcatgttggagtgtgggcctgatccccgggcctcggggatcacagcgtgtgctgtgtgttagtaaatgcttctgcttccttctagactaaagctttgattgataagctccaaaagcttgtgtcatctgagggcagatttaagaatctcagagaagctctgaaaaagtaagtgtgtgtcgttttgtcgctgttatttttaaaatcatagacctgcattgcagaggcattcacgtgccgcccccagccagagcaggaggtctttctgtctgtctgttcgtctgtctacccacaagacccctagatttcctggaccccaatggtggagtcctccatggtctgccagagaaactccagagtttgctagcatttcctgagagaagcacaggaatactgctgggatccctgaaagcatagtagctgtgatgataatagtagtggtgccagatttctcgattctaaaatgcacgttttcttttcacattttaataattctgacatcaggagacgtcttaacgtcagttttgtttatttaacacaattgtgtttcctttttcactccagaattcatcatcaaaatgtttgcattttataaacaatggcatccgggaattaaaaaaatacagttttacaataatcata

SEQ ID NO: 17435 - DNA, 579 bp, Homo sapiens
  ENST00000560286
ccttcttgtattttcaagcaggcaatcatatctgcaaatagtgaccatttatcatctttgcaatacttactcctctttttccctgtcttattgcatcggcttaaagatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaagtaagtgtgtgtcgttttgtcgctgttatttttaaaatcatagacctgcattgcagaggcattcacgtgccgcccccagccagagcaggaggtctttctgtctgtctgttcgtctgtctacccacaagacccctagatttcctggaccccaatggtggagtcctccatggtctgccagagaaactccagagtttg

SEQ ID NO: 17436 - DNA, 662 bp, Homo sapiens
  ENST00000560943
ccactgcagagcagctcaaaaacagtaaccagagccacccatcacaccttcccggcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctg

SEQ ID NO: 17437 - DNA, 265 bp, Homo sapiens
  ENST00000561112
ctcagaactgcctgctgggacaggagccctgccttctgcctccatgtgggctggtcagaggcccgggaggtgaagagcgcccttgtcaaggacagccccaagtaggagtgctggggtagaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgt

SEQ ID NO: 17438 - DNA, 5023 bp, Homo sapiens
  ENST00000310803
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaa

SEQ ID NO: 17439 - DNA, 2895 bp, Homo sapiens
  ENST00000558432
attcccttcctctccaatctgccttcagagcgtggagctgcccgtttgtcccctcactgccttctctctttccccaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatc

SEQ ID NO: 17440 - DNA, 2707 bp, Homo sapiens
  ENST00000561180
ctattgagattatcagcactatcacctggacaagcagcggatgggccgcccctcttggccaggtcttctgtgcgcactgacgttgtatgaaagttgtccccacatctcctacacccaccgacgccaggcggccgcgtctgggccagatatggatcacgcctgtggagcgcacctccacacaggcagccctcgtccaaggtgcagggcgcagggcacagggcacatgtctacggcccagtcctgcagacggctacctagagaccccagggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctga

SEQ ID NO: 17441 - DNA, 2296 bp, Homo sapiens
  ENST00000450598
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 17442 - DNA, 1910 bp, Homo sapiens
  ENST00000559830
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 17443 - DNA, 2151 bp, Homo sapiens
  ENST00000414708
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 17444 - DNA, 1757 bp, Homo sapiens
  ENST00000558164
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 17445 - DNA, 792 bp, Homo sapiens
  ENST00000557875
gagaccacctacctgaagcccactttttgtgacaactgtgctggatttctctggggagtgatcaaacaaggatatcgatgtaaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataa

SEQ ID NO: 17446 - DNA, 843 bp, Homo sapiens
  ENST00000560425
cagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggcccatggaagtaatcatgaggtagcacataccatattaccactgaggataaaaagaaagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaa

SEQ ID NO: 17447 - DNA, 547 bp, Homo sapiens
  ENST00000558418
ttccccttcaggaagtgggagacagtaggacagagcaatcctaatgccaggatgaagagcactagttgcaaccctgaaatctcacctttgctggggagatgtctctttaacagccaaccagtcatttggtgcatttgccaagtgggaggggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgcc

SEQ ID NO: 17448 - DNA, 548 bp, Homo sapiens
  ENST00000561117
tatacaggagaggccctggaggggagaaggcgtcctcactgcagtgctccgagcagcggccgcaggaagaggcgtggaagctgcgggtcggctgcgggaaagggggtcccatgggagccgctaggcgcagcccgtttcccgagctgaggtggaggtcgacgggcacaggtgccctgcaaggcgcgggcgtggtagccgggagcccgctcctctccaactcccctgagacttaaccctttggccaagagaggtcgaaggcgggcaggggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaag

SEQ ID NO: 17449 - DNA, 304 bp, Homo sapiens
  ENST00000560929
ggcgtggaagctgcgggtcggctgcgggaaagggggtcccatgggagccgctaggcgcagcccgtttcccgagctgaggtggaggtcgacgggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtc

SEQ ID NO: 17450 - DNA, 5021 bp, Homo sapiens
  ENST00000539159
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctatatcctgatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctac

SEQ ID NO: 17451 - DNA, 4738 bp, Homo sapiens
  ENST00000402538
atttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattaca

SEQ ID NO: 17452 - DNA, 2144 bp, Homo sapiens
  ENST00000484909
ttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcaatggagtttcactctgtcgcccaggctggagtgcagtggcacgatctcggctcactgcaagctccgcctcccgggttcacaccattcttctgcctcagcctcccgagtagctgggactacaggtgcccaccaccacgcctggctaatttttttgtatttttaatagagacggggtttcatcatgttagcaggatggtctcgatctcctgacctggtgatccacccacctcggcctcccaaagtgctgggattacaggcatgagccactgcgcctggcctagttatgctatctttcaaagaaagaccaatttcaactatttcatgaccatgcacttacacaatctgtggaattatctttggtgataaaaagttgtgtaatttgtattctcttcagataggcaaagagtgactggataaccgatttgcgacatgccactcatgatatttccaaagcctatggacatttgactttggaaacagggtcagcttagtcttcagacaccgtatttgcttaggataattttgtttgtttgttttttcagacagagtcccactctgtcacccaagctggagtgcagtggcacaatcttggctcactgcaacctctgcctcccaggttcaagcgattctcttgcctcagcctcctgagtagctgggactacaggcgtgcaccaccacacccagctaatttttgtgtttttagtagagatgggttttcaccatgttggccaggctggtctcgaactcctgacctcaggtgatccacccaccttggcttcccaaagtgctgggattataggcatgagccactgtgcctggctagcttagggtaatattttttttttttttgagatggagtctcgctttgtcgcccaggctggagtgcagtggcacaatctcggctcactgcaagctccgcctcccaggttcatgccattctcctgcctcagcctcccgagtagctgggactataggcgcccgccaccatgccgggctaatttttttgtatttttagtagagacagggtttcactgtgttagccaggatggtctcgatttcctgacctcgtgatctgcccgcctgggcctcccaaagtgcttggattagaggcgtgagccaccgtgccgggccgcagcttagggtaatgtttttaaaggaacttagtgatcatttttctgtcttgaagactcatatagtcaagttggagttataccaactatggcatgatgtaacgttaccttttagagacaatttggttgtttcctgaggtatgaaaactgcagtctgctcttcagtgtgcacgctccttgcccaacaaaaccatcggcattcttgaaagttctgcctgagtatagcacctttattcctgtggaggtatagtgcattctaactaccatgaatagtgtccactgtgatcatttccctctgcacgattatctgcccacaactgagagagtcttaacttgctagaataatggggacgcttcactatctgtcagtttcccaatatggcaattcagttcattgtatgacagcatcatcagaatgttgccaagatcataaaaatagcagtgcatgttgcctgatgattttacagtgcatattgtcatggccagggcttagaggtaggggaaaaacatgtggacagctttgtgacaagagtctctcttatagtgtttctttctaaagtaactttttctgagtatgaatgtgaaaggtagccttctttgaattaaaaaatattctgaaaaatg

SEQ ID NO: 17453 - DNA, 558 bp, Homo sapiens
  ENST00000497723
ttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcaatggagtttcactctgtcgcccaggctggagtgcagtggcacgatctcggctcactgcaagctccgcctcccgggttcacaccattcttctgcctcagcctcccgagtagctgggactacaggttctccaaaatacttatcattcaggttgaataaaccagttctacagactgcttcttccatgcatttcccaatgatgctagctgcccttaaaattctttcagatttggaactgtatctgtatggaaacaacag

SEQ ID NO: 17454 - DNA, 631 bp, Homo sapiens
  ENST00000479528
tcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatatatcttttcaactactgtgtaatttttacaatcataaatcaagctctg

SEQ ID NO: 17455 - DNA, 861 bp, Homo sapiens
  ENST00000437184
gaaatagctgtctatcacaggcagctaggaactgcttgcccacttttttttgttctgaaagaaaggatacagaccatctgggccagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctca

SEQ ID NO: 17456 - DNA, 4807 bp, Homo sapiens
  ENST00000403687
acagagcaacttccacctgctgtgcgagttggtgatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgta

SEQ ID NO: 17457 - DNA, 688 bp, Homo sapiens
  ENST00000482857
aagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatatatcttttcaactactgtgtaatttttacaatcataaatcaagctctgtatttagatagagtgtctatccaaagccagtaaattaagatgaataaatagtctttggttatccagctgttttgtgaatatatatagatgtctag

SEQ ID NO: 17458 - DNA, 596 bp, Homo sapiens
  ENST00000442390
aacagctgctctcggcgtgctccggcacttggcagctggacaggcagagtgctgatgtgaaaaataccacgacaaaaccaccctaatggagtttcactctgtcgcccaggctggagtgcagtggcacgatctcggctcactgcaagctccgcctcccgggttcacaccattcttctgcctcagcctcccgagtagctgggactacagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttc

SEQ ID NO: 17459 - DNA, 540 bp, Homo sapiens
  ENST00000425210
acttggcagctggacaggcagagtgctgatgtgaaaaataccacgacaaaaccaccctagtgttcatttcactgggcaggttgtctaccagaaccaaggggcctctttgaattttctttcaagctattaataagaggcatgcatcctcctagacacaatcatccatttagtaaaataggttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttg

SEQ ID NO: 17460 - DNA, 554 bp, Homo sapiens
  ENST00000444784
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaa

SEQ ID NO: 17461 - DNA, 557 bp, Homo sapiens
  ENST00000423159
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaac

SEQ ID NO: 17462 - DNA, 875 bp, Homo sapiens
  ENST00000494927
ggcagagtgctgatgtgaaaaataccacgacaaaaccaccctaatggagtttcactctgtcgcccaggctggagtgcagtggcacgatctcggctcactgcaagctccgcctcccgggttcacaccattcttctgcctcagcctcccgagtagctgggactacaggtgcccaccaccacgcctggctaatttttttgtatttttaatagagacggggtttcatcatgttagcaggatggtctcgatctcctgacctggtgatccacccacctcggcctcccaaagtgctgggattacaggcatgagccactgcgcctggcctagttatgctatctttcaaagaaagaccaatttcaactatttcatgaccatgcacttacacaatctgtggaattatctttggtgataaaaagttgtgtaatttgtattctcttcagataggcaaagagtgactggataaccgatttgcgacatgccactcatgatatttccaaagcctatggacatttgactttggaaacagggtcagcttagtcttcagacaccgtatttgcttaggataattttgtttgtttgttttttcagacagagtcccactctgtcacccaagctggagtgcagtggcacaatcttggctcactgcaacctctgcctcccaggttcaagcgattctcttgcctcagcctcctgagtagctgggactacaggcgtgcaccaccacacccagctaatttttgtgtttttagtagagatgggttttcaccatgttggccaggctggtctcgaactcctgacctcaggtgatccacccaccttggcttcccaaagtgctgggattataggcatgagccactgtgcctggctagcttagggta

SEQ ID NO: 17463 - DNA, 4210 bp, Homo sapiens
  ENST00000407811
gataccctttacactagattagcaggcaaaactatgatggtttgtgatatccatgcttgtagaagtaataagaagaaagggaacacagaagctttattttatagtggagtcctgactctaggccttaataattgcatggttttggagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaagg

SEQ ID NO: 17464 - DNA, 477 bp, Homo sapiens
  ENST00000477927
agaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgggaatatctggagaggacatttgccttacatcccaattcacgtaaccaggagttttaaaagctgatgtttctgttgcgtggg

SEQ ID NO: 17465 - DNA, 566 bp, Homo sapiens
  ENST00000490150
ctgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcaggtaggaacaatttagcaggcacttag

SEQ ID NO: 17466 - DNA, 548 bp, Homo sapiens
  ENST00000419772
gccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcagcctgggagacagagtgagactccgtctgaa

SEQ ID NO: 17467 - DNA, 3764 bp, Homo sapiens
  ENST00000468856
ccatcgctgagccagttatccatttgacacatggaaatacccaagggtgttctggttctcttgagagagcatctccttgccttactgtgtggcttatttggattcttggttggctgtggtagtgcttctgtcatctcatctccagcagatgctggtgccagtcatcacaggacttggaagctgagtcaggaggaagggaacatgctcctccaagtctgcactaactcctgataacagggaattcagaaggaaggagtcacttggttttctctctttatttatgtaaccttcacagtgcgaggcttcaagctgggactcagggtacagaggtgcaaaagacagatgtgctgcccactttcatgaggcttagagcctggcacagttgtctgttgtgggaattacaaaatagtaggcaactgcccacggctgatgtattttatttggcccatacggaatcctaaacttttgtcgttgttagttcccagtgtttgaaaattgggatagtttatctaaaactccagatttctggcttctcttaacaaatcagaagacttggcaactcaaggtccaacgttaggctgacagcaatttgtcatcactgagcagtgatgttcatcacaaaccgcacctctccctgtgacttccctaacagagagtggtgtcaggtcccacttatcatcacacatttttttttattgtggcgctaaggggaaagatccctaaataaattacatctgcaaagactctgttttccaaataagacgtttctatcaaaatgtaccttttacgcatcctacttggctcttttatataatggtatggctcccaaaggcatttgtttgtgacatgcggatgtttcctttcctgtaaaaaggcagagcctgggaggtgggagtgattactgttcaggggaaggtgaatacgatgtctcttctttgtaagcaggattgtcatgatcttgaaatgatactggggagattttacagttaagtcggttttattttgtttagaaaaaaaactttgtgacaaagtgcaggtaaaagaaacgtgacctgattatgaagtccttaatttaaatgttatattcaagcagctgctagaacagtgactagaacaatccctgacacatagtagattactgataaatatttgttgaatgaatgatttgaaaatgaaattttatgacaccaacttcatttttaaaggaagtagaacaggaaaaggaatctttgaaaacatcttcgcctctgagttttctctggcttcctccttctttcttttcccccacactccacctcatacacatgttagataaaatatgttaaagaaaacttttcattcctacatggtcaaagaagggagcccgcactggttatgttcatggccagggaagtgatgtgattcattgagtgtcctagctttaaaggactaggtgagaatggttcaggtttattttaagcctcatgacttctgttttaggtgagtggaaacatgcactgtaaggctttacagagtttatccatgttctccagcctggatctgtgttgttgtccttgcctacaatgatcttcctctctcttttgtccaaattaagtcccaatcctcctggttaagtcccaattcacaaggacctccatgaatccatcctgatcatttctgtctccggggcccctatgcatagtaataatataactaataacaaatgcgataataacagtaacattaacactataaaataacacttcttgagattttattgtgtaccaggtcctgtgtgaaatactttacatgcattatttcatttggtcctgacacaaatccaactcagtagggacttttatgatcatttccattttccagatgcagaaactgagtgtcagagaggaaattacttgctaaaggttacagagctagccagtggcaggctgcatgcttgaacccagccctgcctgaccacacagcctctgccctcgtgtatttactatgctgcctccctgatttctgaccggttcctggagcacttaaagtggagcaactacttcacactcagcatgtgctgttttattgctacgaacacatctttttaggttcaggccctgtttattcaaataaattatcagggccttgagggcaagaaatgattttatatcagcttgcctcactaggacttagcacaatgctctcaaataataggagcctagttaactgctcctttatttcaacagttctttaatcaaacttcaaaggcagcatttattacatttacaagtcttattgtttgcatctgtccccacttccagcctggaaacatcacatatccctcatccgtgactcagcactgagcacctgggagctgctcagtaaatattgctgaggaattgagttgatggttctcgtcaatactgatgattaaccaggattaacgttttctcttttaaatttcattttccatctctgcgtgccgtctttttattgttctgcatttactcaaattattagacagtgaacttaaaacattcaacttgaaaaaaaattcagcaacgtaaataaataaataaatgtaatccgacatttttatcccttctaattttgttgtagctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcaggtaggaacaatttagcaggcacttagtcctaccaggcattgggtcctggggagagtcgatcagaaaggcccttttccctttgttgtctctcttgcccagatactctcagctacttccagctcctctctttcacaggcatttgccacctctgtcattgtcaacagctcaagggattggggattagaatcactcatgaaaaacccacataggtcccactaagatgcccaataaattgattacccaagggcaggaaagaaatcctgtaagttggatagtttctccttttgtatagttttggaattttatgacacagcagcccgatgttactgagattagaaaaatcacctaatgtaggacaaggctctgtcagagttttccgtgtagaaaaaagagtagggccgggcgcggtggctcacgcctgtaatcccagcacttgggaggccgaggcgggcggatcacgaggtcaggagatcgagaccacggtgaaaccctgtccctactaaaaatacaaaaaattagccgggcgcgatggcgggcgcctgcagtctcagctactcaggaggcagaggcaggagaatggagtgaacccgggaagcagagcttgcagtgaggtgagatcgcgccactgcactccagcctgggagacagagtgagactccgtctgaaaaaaaaaaaaagaaaagaaaagaaaagaaaaaagagtagaagtgccgatgggggaacacggaaacatctcgggtacaggaaactgcgatcctgaattaaatgtctactttaatggattggtaggtacatctgctggtgcaacagaattgagtctttgggatagaatgtgctttttgctgggagaagatattt

SEQ ID NO: 17468 - DNA, 574 bp, Homo sapiens
  ENST00000482731
tgagattagaaaaatcacctaatgtaggacaaggctctgtcagagttttccgtgtagaaaaaagagtagggccgggcgcggtggctcacgcctgtaatcccagcacttgggaggccgaggcgggcggatcacgaggtcaggagatcgagaccacggtgaaaccctgtccctactaaaaatacaaaaaattagccgggcgcgatggcgggcgcctgcagtctcagctactcaggaggcagaggcaggagaatggagtgaacccgggaagcagagcttgcagtgaggtgagatcgcgccactgcactccagcctgggagacagagtgagactccgtctgaaaaaaaaaaaaagaaaagaaaagaaaagaaaaaagagtagaagtgccgatgggggaacacggaaacatctcgggtacaggaaactgcgatcctgaattaaatgtctactttaatggattgtctgtatttagaaactatgatcacgaccatgatgggtacatttcccaagaggactttgaaagtatagctgccaattttcccttcttggattccttctgtgttctggacaaagatca

SEQ ID NO: 17469 - DNA, 1597 bp, Homo sapiens
  ENST00000601530
attacccttgaccttaacaccacttcttggcattctcagggtttctggcttatggtgggcttgatgccctatgtgcaagaatgagagaggatcttttgggacagctaactatcagtctctaagttcctctagcagcctggattgtgaagccctttcctccttcacttcctgtacattcctgccaagtgtgcgtttatttcttctgtttctgacctcatttcctgtccttggcctgatctcattttccactggcaaactgccatcccactcccacttcctgactctccattctttttctttcctttgggaattcaggatgaataattctttgactgaaagggaactctttgtccagtatcctttgtcctccttgagctgtctctgctgagaactacaagtcccacaatgcacaagaggtgatcttaaaatactcgagaaacttgtatacccttctatcaagtagggatttgctcacggagaccctttgggtgttgactgtagaatggactacaactcccagaagactttggtggagctccccactatcttcatgctctattaccctgaagcttcctgggagttgtagtccaatcacttgtttccacttctctattttctcagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcgg

SEQ ID NO: 17470 - DNA, 3308 bp, Homo sapiens
  ENST00000222145
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccaggactttgtggtgtatgtgatgacgcgagagcagcacgtgtttgggcgaggtgggaactcgtctggccgcggggggtccccggctccctatgtggacaccttcctcaacgccccggacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccgtggctgcccgcgcgccccggggccacgccgccaggccctggctgggccttctcctgtcgcctgtgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcgg

SEQ ID NO: 17471 - DNA, 546 bp, Homo sapiens
  ENST00000599291
cggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggc

SEQ ID NO: 17472 - DNA, 614 bp, Homo sapiens
  ENST00000594232
ttggggcttaggcgggacgggggctggttgctggtggtggcttggagtggcctgaagtggctccgaattggggttagggccttctgcaggcatttcagactgccttggaggaggtggggtgtgtagcggggtctgcggagtagtagatcctgaggagcgtttgtggagtccagtggaatgggcaggagtccgcaggggcctaagggattcgccctgtgtggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccaggactttgtggtgtatgtgatgacgcgagagcagcacgt

SEQ ID NO: 17473 - DNA, 1995 bp, Homo sapiens
  ENST00000248706
aaaacagccggcgcgccgcgcgagtgcagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaaga

SEQ ID NO: 17474 - DNA, 661 bp, Homo sapiens
  ENST00000515677
cctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtgagacaatgcatttgagaaaaattctgtcccattgcaggaggactgcggttcccattttccagcgcttcccagggaggttctttcagtgacagtccgagcctgaggatcccgccacttaaaactttccccagtccccagccctccatggcgcccccctcccataactaccatctggcctcattccattccaagcccattcatcattttatcaagtgcctgaaagtattccccttggtatgttttaactatagtgaccccagttggaagcaccctttgtagtcaa

SEQ ID NO: 17475 - DNA, 1733 bp, Homo sapiens
  ENST00000505041
atcaagtactcaagaaaacagaaacctcacataggctgagcaagataatttgcatcaagggagtactctaaaaatggaaactttgtttaaaactagataaataagttttcaaaaacttgcaaactttgccctggttttaataaatctaacatagggttaaaattgctgttgttttttaaaaaaaatctgaagtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaa

SEQ ID NO: 17476 - DNA, 2640 bp, Homo sapiens
  ENST00000220062
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagccgtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacagaa

SEQ ID NO: 17477 - DNA, 1523 bp, Homo sapiens
  ENST00000421977
ccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagcccca

SEQ ID NO: 17478 - DNA, 982 bp, Homo sapiens
  ENST00000434605
tggctcatgtgatgtggtggcccgcaggctgtatggctgcaggcccggagggcatctggagacctgtgtgatcactcatatccttagaagaaatggtaataatgggtccagaattggtgggttcttggtctgacttcaagaatgaagccgcggaccctcgagccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagca

SEQ ID NO: 17479 - DNA, 5201 bp, Homo sapiens
  ENST00000478553
gtggctagtgaggcccagcctgtatatttctaacagggcgccccatgccccagcaccctccccactgggaccactcctcatagaatagccccactccaaagcatttatgacttgaaccttctgaccaaagctctctgaatcttgggggaacctagaagaggaaaaggaatgtcaggctctgtcagagtcagccaagcgagatcagccaggggtctgctccctgcagaccatacggggagccagggtttgcaatgagtctaaactggaatcttaccctgcaaaacgaatggccactattagagttttccaaaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagaga

SEQ ID NO: 17480 - DNA, 5427 bp, Homo sapiens
  ENST00000379400
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcagcctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagaga

SEQ ID NO: 17481 - DNA, 5282 bp, Homo sapiens
  ENST00000379376
aatgctgtgagttccttgttaggcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 17482 - DNA, 1973 bp, Homo sapiens
  ENST00000302188
caggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtacccgagcgcgcccccgacagacgcaccgacctgcgcgcgcgccgcgggcaggatgcgtgcgcactccccggacgtcccgccccgccccctctgcggccccgaagctgggcggcgtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaa

SEQ ID NO: 17483 - DNA, 2151 bp, Homo sapiens
  ENST00000449378
ggacagcagcacctttgagcgatggcggcgtctggggaaccccagaggcagtggcaagaggaggtggcggcggtggtagtggtgggctcctgcatgaccgacctggtcaggaggatgtgcatgaggatatgttatgtgcacttttgttgccagcccacaccacagctgcagaactgttcaagtctttgcgtgattacatgtcaggaaaactgaactggtcattttgtgtgagtatatgcatggacagagtggctgccatggctggacagcttctggtttcactactcacatcaaagaggttgcttctgaatgtgagtctacacaccatgtcatccatagagaaatgctggctagccaaaaaatgtcacctgaacttaacagcattttgcaggatgtgattaaaattatcaaccacgttaaagtacatgcccttaactcacgtctcttcgcacagctctgtgaggaggtgggtgcagtgcacacatgtcttctctcacacacacaagtgagatggctttctaaaggtagatcactgatcagagtttttgagttacaagagccactccggagatttcttttagaaaaacagtcaccactggcagcacatttcagtgacacagaatgggttgcaaacctggcttccttgtgtgacatattcaacctgctcaacgaactcgatctgtcacttcaggggagaatgacaactgtgttcaaattgtcagataaaggggctgcattcaaagccaaactggaattatgggggtgacaagtgaacatggggatttctgacatgtttcaaacattagcagatattttgaaagagactgaaccagggccttctttcccccagctggtgcatgatcacctatctcagcttttaaaggagtttgagcattacttcccaaccacaaaagaccccccagactgggaaggaatggatctgcaacccatttgtggataagccaaggtgaatcgactttgtccgtgctggaaaaggaccaactgcttgagatcgcaaatgacggtggccttaaaagtatgttgaaacagcttcaaatcttcacacagtccggattgaagtcaaggcataatatccagagactgccccaaaagcactgaaaagcttgcttccatttccaacaccctatctttgtgaagcagagttttctgcagtaacagcaaccaaaacgagattatggagtagactggacataaacaacacacttcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgt

SEQ ID NO: 17484 - DNA, 735 bp, Homo sapiens
  ENST00000458185
caatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacatttagcagaaaa

SEQ ID NO: 17485 - DNA, 630 bp, Homo sapiens
  ENST00000453412
gtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcaggagatacatcaggacacagtgatgaacatttgttgaattagtgcatgaatgaaggaatatatgacttctagttacagttcttgcttgtggaagaggaatgctgctgatactgggagtgcagtgggcaagatctgtcttacttctcgtttgccaaaaactggagaaaccatccatggacataagttttttattggctttggaggga

SEQ ID NO: 17486 - DNA, 54 bp, Homo sapiens
  ENST00000612015
gtattatccttgtaccttttctgtaaatctaaaactaaaaaaaatgtcctcgtc

SEQ ID NO: 17487 - DNA, 2067 bp, Homo sapiens
  ENST00000520132
ttggcttgtattatgcttggctagatgagacttctgggcagatagtaatggaaattacctcttccaaagagataaagtggagaagaaactcctgtaagtttataacctgcccttggtagcctgtctccattaaaccctatctaagtgagctagacaacccccaggggttggcagactttcgctgtaagaggctggatggtgaatattttaggcattgtgggccacatgcagtctctgtcacgtattcttgttttaaactttcttggctcatgggccttgagagctatggtttgccaacctcttatctagggtttagggtctttaaagaacctattagaaccccctttcctccatgggaaaaaaccctgagatgtttgagaacctttatttactcattatttttctttccttctctcaatcagcagcacccacagtaggacaagatatggggtggagacctgcgggtagttaggcagataaccttggggcccacctgcctagtggtgtgtcagtgaaagttaatccattttcagtctcctgggtacatcttttttaactcccactttcatttttctctgcctgtttcccttcagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 17488 - DNA, 2342 bp, Homo sapiens
  ENST00000199814
aagaagccctagacgcgtaaataagacgccgaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 17489 - DNA, 1386 bp, Homo sapiens
  ENST00000447771
caattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataa

SEQ ID NO: 17490 - DNA, 989 bp, Homo sapiens
  ENST00000522469
gggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaaggtttgtgggtataagttagagagttatttttgcctttaactgccctggaataatttatttgcaaaaactgcaagaatgatcattctgtacaaaatacatttttctgtagtctctctattgttagtatcatgctgactggaatttttgtaaaattgtcctttatggtgccacagtaataatgt

SEQ ID NO: 17491 - DNA, 566 bp, Homo sapiens
  ENST00000518917
agctacagctacctccggacgctctcaagatggcgacctctctgggttccaacacctacaacaggcagaactgggaggatgcgacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcct

SEQ ID NO: 17492 - DNA, 660 bp, Homo sapiens
  ENST00000521248
gaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagaggtatgctgccactttttggataaaaatcctaatgaattgacacagtctgtataatttatcttttgaatttgtcatccccacttagatttctaactctgatggaacacggccagttggcatgctggggaaagccacatctaccagtgacatgctgctcaaactggcccggaccacaccctactacaaaaggaatcga

SEQ ID NO: 17493 - DNA, 566 bp, Homo sapiens
  ENST00000521594
acttcgggttcctgccgtgcctagttccccaccctcgcttcccgccccctcgccaccccaagtgtcactgaggtgtcagggtcttcggagggtggtcctcaaccagatttcccattttcaccaggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagaggtatgctgccactttttggataaaaatcctaatgaattgacacagtctgtataatttatcttttgaatttgtcatccccacttagatttctaactctgatggaacacggccagttggcatgctg

SEQ ID NO: 17494 - DNA, 731 bp, Homo sapiens
  ENST00000521464
ggatggaaggaggaggcgaagccgcgcaccttgcaagctggcaggacagggcctgcggcgcggccgaaggaataccggggaggagccagcgcggcggcctagcttggccggagcaggagggcggagggcgatcctcctgcgggcttgaagggagggggcttagccagggtcccgggaccagcaccctttccatccctgccccctccagcctattagagctggttttcttttctcccgccgcctgccggaagtgcagacagcgccccctcccgcgatcgggtcgtgatggacttcgggttcctgccgtgcctagttccccaccctcgcttcccgccccctcgccaccccaagtgtcactgaggtgtcagggtcttcggagggtggtcctcaaccagatttcccattttcaccaggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagag

SEQ ID NO: 17495 - DNA, 2703 bp, Homo sapiens
  ENST00000379052
ggagagagcgaagtcaagtctccagggccgctggcgacttcggaagccgcgcgcccggcgctctcggccgcccccggccgctcgcccccgccgcgccgccgccctcgcccccgggctcgcccttggcccccggcggccgcgaaagggtgcgggagacgcggagccggaggaggaggcgcagccgctgcccgagccgcagccgcagccggagcccgagccgcggggcgggtgcgaagatgcacacgacccagaaggacacgacgtacaccaagatcttcgtcggggggctgccctaccacaccaccgacgccagcctgcgcaagtacttcgaggtcttcggcgagatcgaggaggcggtggtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttc

SEQ ID NO: 17496 - DNA, 1544 bp, Homo sapiens
  ENST00000509686
gtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcggagataaacaagctggctgaccctcaggtgcctgatagtcaaacaggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcag

SEQ ID NO: 17497 - DNA, 1034 bp, Homo sapiens
  ENST00000425446
acaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaa

SEQ ID NO: 17498 - DNA, 622 bp, Homo sapiens
  ENST00000503965
agagtaggacaatagctattgtcgttggggagtgttttcgaggttgggagcgttgggcggatgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaa

SEQ ID NO: 17499 - DNA, 2394 bp, Homo sapiens
  ENST00000318204
gatctcagttttatcatgaatgacttctccattgtgattcttgatttccttcatgggttaatttagaggttatgtatgtatgtctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataattttt

SEQ ID NO: 17500 - DNA, 677 bp, Homo sapiens
  ENST00000504055
aaccatggcttgttattctaccaaggcattaaacataaatgagagttgttttgcctttggtgttcaacaacttcatccagcccttatacaaagacctttcggggctcgtatacagttaagctaactgatcagaaggataccatgataagaggtggaatagttctgtttggaattaaactctgtaaccagtagactcagacacacaagctcagatggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagcttt

SEQ ID NO: 17501 - DNA, 1222 bp, Homo sapiens
  ENST00000510826
acacgttgtagacacggcagcctccagggacagtgtttcataaagccacacctgttgttgcgagtgagccagtcacctgacctgcagcaaagttctgagtgtgtgcatgaccacgcgcctggtttctgacaagcagttaagaacatctctgagtgtcctcagaaacacttgatgacgtcgtttctcctggcactgggaaacatctacaagtctggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaaca

SEQ ID NO: 17502 - DNA, 1413 bp, Homo sapiens
  ENST00000508508
gcgcctggtttctgacaagcagttaagaacatctctgagtgtcctcagaaacacttgatgacgtcgtttctcctggcactgggaaacatctacaagtctgagataaacaagctggctgaccctcaggtgcctgatagtcaaacaggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaag

SEQ ID NO: 17503 - DNA, 6910 bp, Homo sapiens
  ENST00000261973
tggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtcagagttggttgatttttagaattgtatatataaagaattagacattaaacaggcatattctagtgtctgaaaatacacataagaaatttctattaagttgcttgaactttgtgggttaattttaccataatctcataaattaattttagtttgaaaaccttatacagtatgaattcattttgccatttcaagttgttatataaagagcatgaaagtctttttttgttgtttttttggggtttttttttttttgagaggaagttgtgcttttgtcgcccaggatggagtgcaatggcgcgagctcagctcacttcaacttccgcctcccgggttctggagatattctgcttcagttttctgagtagctgggattacaggtgcccaccacgacacctggctaattttttgtatttttagtagagacaggatttcaccttgttggccaggctggtctcaaactcctgacctcaggtgatccacccgcctcagcctcccaaagtgctggtattacaggcgtgagccaccttgcctggccaaagcgtgaacatcttaagaaccagtcttgatctggcaaaaaagtagtagaatactacttttctttatttgtccctaaaaataaagtatgtacatctgttcacaaggaagaaaggtaagtttgaagttgtttttcttaaactttaatgtgaccccaaatcatctgaggagtgcttgtagaaatagagacactgaagtagcagcgctggggtggcgccgcaggctttgcatttctggacagctcccagctaatgtcattgccaactgatccaagactacattttgattagcactttaaggtgtctattcagtattattttatcctaacagactacataaatgcagctgaattttcctttaagtagattttaaagagaaaaacattttttgaggcaaatacacgtaactcatgaacgtaatgtaatcttgcaaaattatgtctgagaaagccctaatattctaggctttttttccatccagccctgaaaattttttctgtagataactttatgttgtaacttattctgaatcttattatggcatttccctgtaaactatgtaagtgtaagctaatgattattttgtgaagcgtgctgtttcaggtattaatctgccatgaatactagatatagtagaaaaactgagaaaacatttagcttgagagccaatttgaactagacactatctttttttctcctttttaatggaataaatttaatgcaaataagtgtaagcaggtatacaatgtttagatgaggcttattttcccaactctttttaacaggttttatgatatccccaatttatacccaaaagactgctgagaggttttatgtcaaattgattacaaacttctctgggttgtatttcagtcttctgttaagtatgaaattgagaaatagttttgctcaacaaaagatgatgagggattgatttgtgaatgtcactggagataaaagggtatgagaaggaatcccaagcaggcaaagaaacagtctagctgtcaagaagaaaacagggagatacataccaaacccaggagctactaatataacaatcatactatagagcgaagtgaacttacactttttgataaactgatagattttttgtaatgtgattatggtaaaatactgaaatatttatgttaatttatttgcatttgaatgcttacatttttaattgacagaatctttgcatttcattacttgagtcatgaaggcgaaattaaagaatggcagtctaaaatacccaggtaaagaagataatttctagaaacaaaaataaaaattcttttcaagccatgttgtttgaattaaatgac

SEQ ID NO: 17504 - DNA, 3375 bp, Homo sapiens
  ENST00000527432
gaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggggtctttctctgtctctcagcctcaagccatcctcctgcatcagcctcccaagtagttgggaccatagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtcctt

SEQ ID NO: 17505 - DNA, 1039 bp, Homo sapiens
  ENST00000531500
aagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggacggagtcttactctgtcgttcaggttggagtgcagtggcgcgacctcggctcactgcaacatctgcctcccaggttcaagcaattctcctgcctcaccttccagagtagctgggattacagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggac

SEQ ID NO: 17506 - DNA, 6848 bp, Homo sapiens
  ENST00000532683
atcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaatta

SEQ ID NO: 17507 - DNA, 2470 bp, Homo sapiens
  ENST00000525321
ctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 17508 - DNA, 1567 bp, Homo sapiens
  ENST00000526754
cgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 17509 - DNA, 541 bp, Homo sapiens
  ENST00000525161
agaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaag

SEQ ID NO: 17510 - DNA, 3008 bp, Homo sapiens
  ENST00000528081
taagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggttgggatgaaagtagtaagggaggctggacaaggttaacttgccagagaaagcactggtacagactattccaaacagagctaattcattaaggcagctttgtaaaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactc

SEQ ID NO: 17511 - DNA, 898 bp, Homo sapiens
  ENST00000532192
taaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgt

SEQ ID NO: 17512 - DNA, 1052 bp, Homo sapiens
  ENST00000532483
gaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactggttttactagtgctcctatatctgcagctgcctcgagttctgagaagaagtgaaaagtttaattttctagcacttgtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatg

SEQ ID NO: 17513 - DNA, 3469 bp, Homo sapiens
  ENST00000527449
aatttaaaatgtctaatgtgacctatacttaatatatggagtatatgaaaactaaaatttaagaggacaagaaaaatcttttttttaaccaaagtattattatatttattatggcatagagtggtattttatacatatctcattttacagtaaaaacattttatgtacaactgtagagagatagctgcacagatagctccaacttaaattagaaaatattttctctatagaaaataataaaaacaccgtttcccaggctagcccaacaagtttatttaaaccaaatagctgaatacatatacatttataaatatggtttgaattctgggatccaggagaaactttagtttcatttattgaaacggccatgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 17514 - DNA, 441 bp, Homo sapiens
  ENST00000530978
aacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagc

SEQ ID NO: 17515 - DNA, 4243 bp, Homo sapiens
  ENST00000540163
agatcgggttcaacggcagggattgggtaaggtgagaatctggcttggcggctccggccccggccatctggttcccttgggctccggccgccaccatccactcgacggctctcggcccgaacgcttggtcgcaccgcctgccgaggtcctagatgaatcgcttcaggcctggaaacgaggaagccgtctccggagaccatcgccaacgctgacgcccgcggtctgaggtcgccatgggaagagcggtaggccaccctgctcctctgatcaccggaggacagggacacattgttcagggccatattcaaacactgcccgcagtacttgcgttacgtccctttgtgaaggcaggcccttcgcggctccccagatcagtccagcctgtgtcggacccgatgactaagcacacaggaacccataactgagcctgcggaagagccagaagccgccttgcctttaacgaggggtatcctggcgagcatgcgcagaccgtccgcgcacgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctga

SEQ ID NO: 17516 - DNA, 2064 bp, Homo sapiens
  ENST00000375490
acgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtt

SEQ ID NO: 17517 - DNA, 6725 bp, Homo sapiens
  ENST00000541475
gtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtggtaggttgactatttttcaacttgaattgccaaaaaaaaatcatccttagttaaaatgttcgcattgtatcaaataactggtttttaattaactttgttaagttggaggttttgttcctttagtcctcaaggcgtaagtgaactttttagataactttttctcaaatttttgttagactagcatgatttgtagattgagcactcattttagttttcactgggctgaaatatatacttaaaagactgaagataaatagaagtaaaactgcttttacatttgtttttcttttcaaccatcatttactcattgtctgatgctcctgtaccctatcctgagtgacttatcataaacttgggtcttctagaccagttccattttaaacttaaccttttctttttttggtggtggtaacatcatcatgagactaggcttaaaatcttagctatctttcactgtttcatctttgtcatcatttgttcaagtaggaagctgttggtaactatttggtgcctaaatcatgatcttgacttgtagtccccaggcttttgtatttcataggtctgcaaaatgaaatatagaagtcaaaataaatttgagagaccagtataaaggatgttaacttttatgtacatattgcctatttttctaattgtaccgtagactattaaaataaaaatgatcatatactaatatttatccacaggcagaatttgggaaccaccggtctagtcaattatgcccccattttcccctcactagttcatcttgcacaccatttcagaattaatattacaattctgttttgcttatcttccttgcacattgactttccattgtttgtaagatgaagtcagattcctctagcccaattattagggattcttattgtctgattccagtaaaccctgtagccttacctttaattgttcactgcttattaagatctgaaggccgggtgcggtggctaacgcctgtaaccccagcactttgggaggctgaggtgggtggatcacgaggtcaggagttcgagaccagcctggccaagatggtgaaaccccgtctctactaaaaatacaaaaattagccgggcgtggtggcacaggcctgtagtcccagctacttgggaggctgaggcaggagaatcgcttgaacccgggaggtggagcttgcagtgagccgagatctgtaacctgtctcaaagaattacttggtattctatgaacctgttctgtgtttccctgttatttttgtttgtgcaatttccttttcttggcatatctctcccttaaaatatgaaaatattccatccattgttttaatacccagatcatatgccaccttcatgaaacctttcctaatgatactgatctcctgattctttgttttttacacagtgattttgcattatagtcattttgtgtgacttattctgagttgcattcttgaggacaaagagtagtatttatgtatatatatgtatcttgtaggtatacattggaatgattgaagctattgtactgctttagttgtggatccatctaggcaagagtgactttattttctttcattttctgttaactgaccaaatacatattagctttgatatctagaagtattaacatttccacttttcctattcctcagatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgacttaagtacaaaattctcaacttaatatgacccctatttggcatgtgctacttcagtctcctctgatgacttccccactttagttctcatagtaactgcccttcactgctcaatctatgcattacttcctctagaaagcctttccagagctctgaaatccagattcagtgccaagttatgtattccccaaatatctttttcttttatcatagcctttagactgtattataattttctttttacttgtctgtctctgtagacagctctatgaagacagaccttatcttattcatcactgcattcccaggatccagtgcctggcatatatttaacagtgaaactttttgatgaaaggaagaacgtctgttaattgaataaggaaaaggaggattcaacacataaaactttgaataggctctctaaacctaaaacattgcatcctgagaattacatgtcacagtacatgtattctagaattctatttgttcattttgtcaaacttcaaaaagttttggatctgtattcatgaataatgtgtgactttgtttttattttattttaatttatttatggcagagcctcactctgtcacccaggctggagtagagtggcacaatctcagctcactgctacctccgcctcctgggttccagtgattctctcacctcagcctcccgagtagctggaattacaggcacccaccaccacgcctggctaatttttgtatttgtaatagagacgggttttccccatgttggccatgctggtcttgaactcccaacctcaggtgatctgcctgactcggcctcccaaagtgctgggattacaggcatgagtcactgtaccagcctgattttgttttttaattgtattatcttagtttggtttaggagtatggttctgctagccttataaaataaattggcaagcttatcatcttctatgcccccccccaaatttgaataataaaggaattagccgtttctgcaagatgtgttgaactcatttatacaactatctgggtttgctttggaaatagctctttgattgctttatcaatttcctttagagttatcttttcaggtttgctactttctcaggaaacaatttggataatttatacttttcaagaaaatcaaccattccctttttctgaatatattgctatagagttgtacatagtatttcttataatttttgtaaaactcctaatattgtcaatagtgcagttttagtttctgacgatatattttaccttccctctcatcctcagatgagactggctgtgctgttttggcatacatcttacatttatatatgttataagccccacactaccttgtttttgttaggcagattcttaaataatagaaaattatatataatacttaagaaaaaataggaaaaaaaa

SEQ ID NO: 17518 - DNA, 712 bp, Homo sapiens
  ENST00000544313
gcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaa

SEQ ID NO: 17519 - DNA, 1908 bp, Homo sapiens
  ENST00000542140
gctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaa

SEQ ID NO: 17520 - DNA, 692 bp, Homo sapiens
  ENST00000544582
gctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtggtagtttcttcaaacctgtatactgatcagctgtctcatgaatacgggagaaaacctgcaggtctccgagagttctctccctgtgcaacttatcgcttttcagtgctgtgtaccggccattccagctgcctttgtttcgctggactctcagctgtgtcttctgaactcagtgagtttgccaggctctgcctgccctgtcccccaaccccacacaatgcagcctaaacgttccctcaaggtagcacgca

SEQ ID NO: 17521 - DNA, 867 bp, Homo sapiens
  ENST00000545678
gggggcggcggcggcggaagcggatcgcactctctttgtgggcaaccttgaaacgaaagtgaccgaggagctccttttcgagcttttccaccagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttt

SEQ ID NO: 17522 - DNA, 566 bp, Homo sapiens
  ENST00000538134
gcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggtaactgcccaatgaggttcggggggcattgtttcctgctgtttttaaatttattattcagttttaaagaacctcttatttgtagatgaaacttctttcttaagcattgtgaatagtaaactttatatagcaaactttatatatccctgaaaacgggtaacattgacacatggattttgaaattagaatttcaaaactgagcttaaagtttcattttgggttagtgaaaaaacataaactgtatcactaagagagctgggcttgggtactctgaaaagagctaggtttattttctgaaaatacttctcctggctgctttgtaattacttttatat

SEQ ID NO: 17523 - DNA, 3587 bp, Homo sapiens
  ENST00000624815
acgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgactt

SEQ ID NO: 17524 - DNA, 2144 bp, Homo sapiens
  ENST00000432518
tgctgatccatttgggagcattatggaattcaaagcccagaataatgggctctatttaatattgaacaggttcttgataacccgccatttctctccagagctgcttgaaagtccctcctggacgtgcagagttgcagtggcagttcccatgaagttgtaagctactacccaggatcaagtggtgttaaattgagaagtcatcctgttcacctgactagtggtgaaccctgatttaagaatttccaaggctaccctcgccatctctatttaaatttatagacgcaacgcactgcctgccctggggtcaccaccgaagcctcctggtggagccctgccctgctgaggacgctcttccagcacagaactcaccaccaaaaagagacggcgcccagctggcgcccgccccgggcacattgcagtaaatgcctggcagcgacttctcgcttctccttcctcctaccccatcgaccctctgttgccgacctttacgccaaactccggcgcgccgcgagactcgcgtcctcgctgtccccgaggggccccaccccttcccggttctaacctgcgacctggccagaggcaaggtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcgacgatcccgagacgagacccaacggcgagaaaggagagagcaagtatttcagtgacatcatccactcaggagagttggggcgaggctggctgaggttctcaaggagctgagttttgagttcaggtgctcgtgtagcagtggaatgatgcctcctgacctttcagacctttgagacctctgggcggtcttagaaatcacttcaagcctccagtccaggatacgactgcctaggggaattccagggaaaggtggcagagatgccatggactacaaggtgatgaataccactatgagctcactacaagatctcaaagatttcaagccactggctgttacaaagcataaagccacccttctggagcagcggcgggaggcaggctgggaggaggccccaagttttggccagacgatagaccacctccttaggtgtccggggagctgctgaaacataatgaggaagatgctgctgatccaaaggataaaaacacagaaactagaaccaagaagcacctaaagtggactcatgcccagcatccctgcagactgactttctctgagctatagttctgcattggactgtttttcctttgctatcacctgcccaacacacaatcctggatgcttttgattggttggatttcttttttttttttcctgccttttctttttctttccttgaccctgggaattataaacgagaaattgctttaaaaagtattgttctgtgctaaaattagccttgtttatgaacaagttttatccctagggatttcctgaattgcaatcccagattaccttgtaaatggggctgtgttgtttgatttgtatagtactgatctgtaggttaaaatacgtttcctttcttttgtttcattctttttttaaaagtctggatccaggtaatggcctgagtcacatttgcttagctactgaagcgatctcaatatgttatcgcttagagttgaaacataatcaaacatacgttatacctggggctcttgcacactatttgatatatatatgttactctacaaagaaacacaaaccttgtatgttgaaatgtaattcctgtttgatcctgcagctagaatgctaaagaaattgcaaatatcaaaagtgacttcaaataccctgaatataagctagtcaacagtaagtggatggttccagaataccatattctaagacaaagcaggaattagagatcaactgacctcatccataatgttgctcaggtctgtctgtggatctgtccattttggagtaaaaaacaaggcatgcttctgtgattgtgtttatgaaaactgtagtatttcagatttatgttttgcaattgtgcctgccttgcaataaaacaccttcagttgactcagcaataa

SEQ ID NO: 17525 - DNA, 562 bp, Homo sapiens
  ENST00000443912
aggatgaactgcccggcgagagtgcaggcgctgaggacagcgacgatcccgagacgagacccaacggcgagaaaggagagagcaagtcaggccactcttccatagggctgctgcagtttgctgggggtctgcttcagaccctagttgcctccatttttcccatgcctggaggtatcaccagtgaagcctgcaaaacagcaaagatggcaccctgctcctttttctggaatctccgtcccagagatgccatggactacaaggtgatgaataccactatgagctcactacaagatctcaaagatttcaagccactggctgttacaaagcataaagccacccttctggagcagcggcgggaggcaggctgggaggaggccccaagttttggccagacgatagaccacctccttaggtgtccggggagctgctgaaacataatgaggaagatgctgctgatccaaaggataaaaacacagaaactagaaccaagaagcacctaaagtggactcatgcccagcatccctgcagactgactttctctgagctatagttctgcattgga

SEQ ID NO: 17526 - DNA, 448 bp, Homo sapiens
  ENST00000445077
gagagtgcaggcgctgaggacagcgacgatcccgagacgagacccaacggcgagaaaggagagagcaagagatgccatggactacaaggtgatgaataccactatgagctcactacaagatctcaaagatttcaagccactggctgttacaaagcataaagccacccttctggagcagcggcgggaggcaggctgggaggaggccccaagttttggccagacgatagaccacctccttaggtgtccggggagctgctgaaacataatgaggaagatgctgctgatccaaaggataaaaacacagaaactagaaccaagaagcacctaaagtggactcatgcccagcatccctgcagactgactttctctgagctatagttctgcattggactgtttttcctttgctatcacctgcccaacacacaatcctggatgcttttgattggtt

SEQ ID NO: 17527 - DNA, 1682 bp, Homo sapiens
  ENST00000636680
gagacccaacggcgagaaaggagagagcaagagaacttcagccaacaagtcttcaggtgctccttcctatagcagatggtccagttcacagccacatcagtctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgcttcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgct

SEQ ID NO: 17528 - DNA, 4662 bp, Homo sapiens
  ENST00000636900
gagctccatgggaagaggcccgaggaatgagcacagtcttgacagtttcagtgtgggctgactgtgtcctgaagaatgggctgggaagcagctttacattcagcccctcgaggaaggtgactcatctgggtttgttgccctgtctgatgctcccctacttgggacactgagaacttcagccaacaagtcttcaggtgctccttcctatagcagatggtccagttcacagccacatcagtctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgctttttcagccagatggagccaaggcagaagcccactggtggaacctaggcagatgccagcagacacagaaacctgggaaacaggctgcacattgagtcatcctctaatggaagatgggatggcaaggaatggacacaagggagaactgacgagggatctacacgtgtaggaacttttctctggatgagaaaaatgtaaatccattcagaaacatttcttctctatcagtgaagctctacttatatttaggggaatagaaacatttgagggtatctaaaatatctggtaatagaggaaatttaatatattatttggtgtgctttttacccagtgaacagttgaacccattatttacaacttagcattactttagctgaaaaggtatctggagattaagaaaaattatactgatcataatattaaaaatgtaacttattttttattttgtgtttccagagttagaggataccctgtagtgttctagcccacccatatctttctaatttttaagtgtgatcaccattagaacatgaacattaccaaatggggattaggcttattcatatgtttcatttattttaacctacttgaacactgaactttctttccttataatttgcaaagacaaagtcaacatctggaggaggccatgctgatcccatctatgccataacctttacactgctggctcaactgtgagattgcaaagggatcagtgaactagatcgcagacccccagctccttctggccatttctcacctgctctcttcttcctgcccttcatctgcccacctgtccctctatttttctctctgctgctttcagaccacaaagaaaattgagtgcagtgtcaccttatgatatggattggatgtttgtcctctccaaacctcataatgaaatgtgacctccagtgttttgaggttggcctggtgggaggtattggatgatgagggtggatccattatgaatggcttagtgctattcccttggtgatgagtgaattcatcagttaattcacaagagatctggttgtttaagagtctaggacatcccccttctttctctctttctcctgtttttaccatgtaatgtgtttactcctccttccccgtgctccataattggaagcttcctgaggccttcaccagaaggagatgcagcactattcttggtgtacagcccacagcactatgagccaattaagcctcctttctttataaattactccaccttaggtatttctttatagtaatgcaaaaatagactaatagacatcttacctactcatgccactgtttcagaagccacccccgttccacttaaatatcatacatgatggaaaacaaaacaatacacaaggtagaaaacatcctagatagcagctcctgagggaaggtacacttctacaaaataaaaatcaatgagtttatattttggtagcctgtgatgttatacagaatagacagagattctacttaggattccaattcccttaggcccattaagtagggcagatggacattagaagagatgccttcaaaagtggacattaatgtactcttaaaagtaatgggtctgacctataaatcatgggaggaatgtagtacaaaatagtgaatgaaatatttatacgttccattgaagcttcgtgtatattctagagggagaagtcccagagagatgggtcttcccctttgttctgaatctattttccaattgctctgacacagctgttggcttcacagtcattctgaagttgattagatcagaaagcagaggcctgcctgcccagcatgaccaatgaaaaacataaagtttgtcgctgtttcaagcctggagcatgtattttgaagttgttttggtgtgcatgggccttcgaagtggttctttaaatttcagtgctgctgcgtttgtacatcatctgtgtcccaaacagtgcagcaaaatgtgcagtgcatagacttgcataaaatctaccaatcacatttggaaatggctgtcagatttatggagcatggctgtaattacattcacagaaatgctcagttgaaagcagtaacgaaggcttattacttttgttttgtttgttttaataaaacaaaacacttgagtttaaggaaataaattgttacctatggagaaatcttttgacttgttgttggaatgatttagtgtttctaaaacatgtgctgtaggtgagcctaaatgcagattcgtttttgtctgaaggtcagaaaggtttgtaacaactgctaacagtaatatgagatattatgctaactgcttttcaacaattatttcatttaatcttcaaaattaaaaggcaaggagggagtatgattttcattctccacttacagaatccctcctccctaccagccgagtctgtccttcaccgtattctgatcccaggtccctctaagcacaaagtcatatagataggggagccttttagtgaagccctatcctccttcgaaaagaattctcctaagtgaatactggcctctaggcccctgtgactatgggcacaacctgggatgctttggggcttcatcgatgggaaacttgagtggcactttgccagcaacagcaacacttccacttgcctttctcgtttagttgccaacttggctccttgaaagccttatgagctgggtacggtggctcatgcctataatcccagagctttgggaggccaagtcgggcagatcacctgaggtcgggagttcgagaccagcctgaccaatatggagaaaccccgtctctactaaaaaatatacaaaattagccaggcatggtggcacacgcctgtaatcccagctactcgggaggctgaggcaggagaatcgcttgaacccaggaggcggaggttgtggtgagccaagatcgtgccattgcactccagcctgggcaacaagagtgaaactctgtctataaaaagaaaaaaaaaaaagcctgatgttgccaaagttacctagtctctaaatataggatccagtaccaacaacattttaactatgtcatcgggagtggtcagctgaattattgagtcatacaattttagagttggtatgaccttaaatttcatgtggtctgcacccctccatcttcagctgaggaggctggccttcaaggagttggggggattttactaagccatataagtggggagggtagtctggaataagaaacaacatatattcactcccagttctgaacttttccttatactgtattgccagaacacaccatgaaatttcgctctgcaatagataagagtttcttcttgatactatattttactatgttgatactatattatggaaacaataaatatatatacataataagttttaatttattaatctttacagaaaagagctggcttttcatttatcattttaaactttatacttgaaaattcacttttttctttttttttgaggcagaatctcactctgttgcccaggctggagtgcagtggcgcaatcttggctcactgcaacctccacctcccaggttcaagtgattcttctgcctcagcctctcgaatagctgggattacaggcacccgccaccacacctggctaatttttgcacttttagagtgcaaaaattagtagagacagggtttttccatgttagccaggctgatctcaaactccttacctcaggtcatctgcccaccttggcctcccaaagtgctgggattacaggcgtgaacccccatacctggctgaaaattctttattatctcccttcaaagagacaaacagaaaatgaaattgttgtcttagaatatcttacaataaagattagcttacagaaaaccaagactggtcatgaggttttctttctctactctttcacatgttatatgttttgtaggaattttggccaagaatctagaggctaaatctgtatacatggttttaaaaaactgatataactgcaccaaaaactggagagagggcagtggggacatcacatcctagatattgacatttcaaatggagatactttctttacaagtgtagattcctaacctttaatgcattctgagaatttgacatggatttgttttatagctctcaaagtattcaatttagaacaacaacaaaaattgcattagaaaacatactatgctgggcccggcgaagtggctcacacttgtaatcccagcactttgggaggccaggtgggcagatcacctgaggtcaggagtttgaaaccagcttggccaccat

SEQ ID NO: 17529 - DNA, 1192 bp, Homo sapiens
  ENST00000636582
taggtctaaaaatagtaaggcaatcctaggctgtcctaatattaatgtagagagtgttttctgagaagtctccctataaatcttggaattatctcatgttgtagctggaaggatctagggtcatctactccagtggtggctaatttgaatgtctttcgaggccagacagagaacttcagccaacaagtcttcaggtgctccttcctatagcagatggtccagttcacagccacatcaggataaatataggctgaatctgggagaaatacacatttttcctcacagatcacaaccacagaaggtaaaaaaggagaaagatacagagattcttaagaaataacaagcaaacgagtctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgctgataatcaaagcaaagaagccatttttcacctcttttccattataaattctcccttggtaatccttttgtgatttttgtattggaaattgagggttggctaattgaagtcagatgttcagtgcagagtgttgcagcgtatcccaatttgttgccttgtttctctgttctctctttgtatgatctatggagactccaaaaagttatctggggaagaacaatggcacatttaactcagattctattccagacaagcttatcaaacaatttctgtggaacaagtacagtgttattcctgatagaattctgtcgagatagataggacacataggacttatcaaagagggaagcccgtcacctttattagtctggaacttccttttcttcaatcaacaacatatgtgaaccttcttttcttgctagaaatatagaatatatcttccttttgatttttgcataaagtataataatatagctttacagtaaagtatttaaatcttcccttattaggaaccaaaaggtgttttccagttgttctttaatttcataatgatataatgaatgcaggtgtatgtaacatagtgtatatatgtgtatgtgtatatgtacatgtcagtatgtatatatctccatatgtttgtgatatggcttccttataattgtattag

SEQ ID NO: 17530 - DNA, 1458 bp, Homo sapiens
  ENST00000637842
agaacttcagccaacaagtcttcaggtgctccttcctatagcagatggtccagttcacagccacatcaggatcagactgttaatttcttctgtaaagaagccagctggcatttggataggaattgtgttgattctgtagatcactttgtctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgctcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagt

SEQ ID NO: 17531 - DNA, 8540 bp, Homo sapiens
  ENST00000434693
acgctgctccctggagaggctctctcggttccacccaccggctggaaggaggggaagtgaatgaaaggacaggacaagccccgaacaccatgtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgacatggccggaccagttctttctttgttgtttgtttaaactaccttccactggtgttttacatagtgcaaaaaaaaaaagagggtggggggagttgtctctcttttctttaaatgtgtattcattgatagcagaagcttgtacctgctgtgtttagcagtttcagcatgaagagttctggatatgaactgattcatagagccaagtggctttaaattctgtgagcttttctggtttctcactagctgtcttgaatagtgaaacctgtattgatggccactagtaaaccaagatgcttatttaacaggtggaatattctttatatgaaatttcagctaaagacactttctggacctggtctgaaaggtcatttgtcaaaaaagcttagggatattctgtgaaatggtgagtggtctcctggaaaggtctcattgtatttgaacaatagtcttccctctaaattacaacacctctgggttttgtctttacacctctgtctttgtcatcacctaccatgaatagtcaccttggttttgcaaatggggagggggtatcatctttttgcctgttttcactgtatttttgtatattggtgttgccgaaagaactttttctttcagtttaattctttgaggcatgtaggaccaataagattgagaattctattggtggaatttagggaagtccttaaaatgctagttgacaatcaaggaacagtatgatttatatcaataagaaccaaaagaattaggtttgatcaatcatttaagccaaggaggaatacttgcatttagaacaatgcaaaactttgtctaaaatgaattaaattgacccacctgtaaaatatatctacatttttaattcatgagatgatatgtgttcaacctttacagttttacctgaaattaaggacaatggaatagaatttgttaagtgaaccattcactagattgctttctgaatgaatcctttgaatcaaataggtgaaactcttttcaaaaactaagtcagtcacaggagcctgtcttagtccaaaagaagcagggaaatgtatttaagtgtactataaaacagggtaggctttttaaaaactaaaaagttttaaaggtaaatcatattcccattaggtcaacatgagtaataaggttgactcatgtgaaattgtcaatattctactatttctgtaaactctggttctcttatttgcaaccccatgcactggaagcccaaatcagagaatgactccatatatttatggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaagaaaaaaaatagaaggaaaacaacggcacatactcaaatttgccctgctttgtctgttgtcttacctaagacttgttttgaagagccaagtctgggagagaaaaaaaagcatcaacaggtaagcagcattacattgtgtggtaataaaccaaaataagttttcaatatatacagacaacagaattcaaatttaatcaacaaaatatattgtagtgatttgtttgtttgtttgtttgagacggagtctcgctctgtcgcccatcctaactaggactataatctttttttttttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattgaa

SEQ ID NO: 17532 - DNA, 841 bp, Homo sapiens
  ENST00000471426
gtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtaagtgtccttctgctgcccgtgctgtttctcactcccatacttgccttggtgggcaggatgtgttatttcagtcaatgtactcatccactgg

SEQ ID NO: 17533 - DNA, 1864 bp, Homo sapiens
  ENST00000383767
atcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgcca

SEQ ID NO: 17534 - DNA, 1120 bp, Homo sapiens
  ENST00000445033
caaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatgggtaagtagatcacattttct

SEQ ID NO: 17535 - DNA, 1598 bp, Homo sapiens
  ENST00000273139
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaactta

SEQ ID NO: 17536 - DNA, 2757 bp, Homo sapiens
  ENST00000383766
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccagggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 17537 - DNA, 1547 bp, Homo sapiens
  ENST00000452462
gagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatg

SEQ ID NO: 17538 - DNA, 1394 bp, Homo sapiens
  ENST00000456853
agctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcc

SEQ ID NO: 17539 - DNA, 413 bp, Homo sapiens
  ENST00000497205
tacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttcc

SEQ ID NO: 17540 - DNA, 556 bp, Homo sapiens
  ENST00000478716
cacaggacttcaattttataagagtccagaaagttctgagtaatgcacagaattctacatacacagcaaatgcagccatggcaaaatgtagtccctggtgagggaggcaaacagagaatcaacaatcctttgcttttattggaataataaaaccggagcagtttgtgtctgaatgtgctgtaaaccagattttttttttcatgtaaattctatagccaggatatcacagacattgccatgaaagtggtaaatggagaaatacagtctttggaggaatcttgacttctcagcactctttgtttattcatttaaatgtgcctatttttatggatggtgggtcaagatggcggattcaatgaaatagtatttcataacaaaatgagcatgaagagaatttgggcatgtctaccaaaacacgaaggacaacaacaagagcaagacccaacaaacctatacatctcaaatctccccatttctatggatgagcaggagcttgagaatatgctgaaaccctttggacatgtcatttccacaagaatactaagagacgctaatg

SEQ ID NO: 17541 - DNA, 483 bp, Homo sapiens
  ENST00000497319
gaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaatttagaaaaaaaatactctgggaagaaaggatagatgtctctttgcatggattataattctgatgttttggaaagaaaagagatttctgttactggaccctgggaacttattg

SEQ ID NO: 17542 - DNA, 849 bp, Homo sapiens
  ENST00000473799
cttgaacctgggaggcggagattgcagtgagccaagatcacatcattgcattccagcctgggcaacaagagcgaaactccatctcaggaaaaaaagaaaaaaaaaaaaagagagagagagagaacagatttaaaggaatttgtgatgttctgacaagacttgactcctgactgagttttatggctgatgagggagaaggaaacgatcaagatgacttaggagtttctttgttattctgagaatcgagcagagaagaaagaatactctgagaatgaaagaggaagacagcattcagagcgggacatagtagttttgaggtacatgggattcggtcagtagttggaaatttggatcatgaattcagaagaaacaccaaggcaagaaagacttttttaaaactttaatttttaaactaattatagcacttttgattaatcaagtcttaacaagcgggaatattttggaattttacttctaacaccttatttttatgggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattctta

SEQ ID NO: 17543 - DNA, 785 bp, Homo sapiens
  ENST00000497274
gtggtatttaataattttctcactggttgcagctcaaagttcacatgcatttttctttgattctctctagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaacaggcatttatttagctcatgattatgtgggtttgaaatttgggctaactttgggtggatggttcttctgatcttgacaggaatcaaacatctaggaacagctgctgattatctatgcatctctgcttctgggtgttgctagctgttggatgtgtgatggaagtgactaggccatatgtttctgatcctccagcaggctaattcacatggaagtctcagaatttcaagaatagtaaagagcaagcccaaatgtacaagcactcttaattctgtttattactaattttctactgtctcattagccaaagcaagtcacttggccaaacagtcaatgtagcagttcactttgaaaaagcttgatatagagagaggcactgcagccattaaaaaaaa

SEQ ID NO: 17544 - DNA, 694 bp, Homo sapiens
  ENST00000232217
ctgcagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaacccttta

SEQ ID NO: 17545 - DNA, 489 bp, Homo sapiens
  ENST00000511956
ctgctgcagtcagatgctcccaaggacagcagtctccagaaagcttcttgtaacctggaaagattggttatagttgatcattttcctccatcttaaaagtcacctgaagaattccacaaggacttagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaa

SEQ ID NO: 17546 - DNA, 180 bp, Homo sapiens
  ENST00000506825
tagggagccagcccaggagcccagctgctgcagtcagatgctcccaaggacagcagcctgctccttgccatccaccacaaaccctcaccgaaccagtggccaccaccatgacaagggaccagaatggaacctgggagatggagagtaatgaaaactttgagggctacatgaaggccctgg

SEQ ID NO: 17547 - DNA, 1623 bp, Homo sapiens
  ENST00000372743
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 17548 - DNA, 1636 bp, Homo sapiens
  ENST00000372741
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 17549 - DNA, 2489 bp, Homo sapiens
  ENST00000343694
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttagtctacagacctatgtgcgtgtccctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccgggtctctctaagtctcacctggggaattcggtcccacctggggcaccagttcccacctagagcactgtgtcctgccctagagcacaaagacctgctcctcccgagactctctctgactgcagccaggcatagtacctttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatcc

SEQ ID NO: 17550 - DNA, 702 bp, Homo sapiens
  ENST00000464504
ctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 17551 - DNA, 1661 bp, Homo sapiens
  ENST00000622729
aaaagaaaaggaaggaaggaaggaaaataaagaaaaaagaaagaagaaagaagaaagaagaaatcagctagctcaacaagctttcttaacgctaagtgagagaacttaagggcactgtccaagctgaggggacaagtgaaccccagagcctaggattagtatccagttcggtctaacgcagaagcccacgcgccatgctggctccctacactggtggccaccatgagaagcttcggcctcgtccccttgggtctcctcccaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttagtctacagacctatgtgcgtgtccctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccgggtctctctaagtctcacctggggaattcggtcccacctggggcaccagttcccacctagagcactgtgtcctgccctagagcacaaagacctgctcctcccgagactctctctgactgcagccaggcatagtacctttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatccaa

SEQ ID NO: 17552 - DNA, 1746 bp, Homo sapiens
  ENST00000560606
gttttccatcgggatgacaccgggagagctcgctcgaagcagtgggtaggggactgctgaagcacgtgcattcgttacttgaacattgtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatg

SEQ ID NO: 17553 - DNA, 2008 bp, Homo sapiens
  ENST00000300069
actcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaacc

SEQ ID NO: 17554 - DNA, 3188 bp, Homo sapiens
  ENST00000330430
ctctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgac

SEQ ID NO: 17555 - DNA, 3327 bp, Homo sapiens
  ENST00000371374
agagggaggcggggcgcgccgcgccgcgtacggccccacgcaaaggcccgcgggcaccgcgccgcccccacgcgctcgcaccggcgggcaggtgagcaggcagcgccgcgcgctagcagctggcccccgtagacgccccagccgccgcctccgcctccgcctccgccggcgcatcgcggacgcccagcaggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 17556 - DNA, 3240 bp, Homo sapiens
  ENST00000306764
ccagagggcgccagcgcccaccaagcgcagaagcccgggaggaccatccaggggctccccgacatttcctcagttagccagagtcggggggctcagacatctggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 17557 - DNA, 2457 bp, Homo sapiens
  ENST00000405162
gttactctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaacgctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaat

SEQ ID NO: 17558 - DNA, 527 bp, Homo sapiens
  ENST00000530348
atctgtgtgtggtgcgtgtgtctccgcaccacgactccctctcctgggtctgctcagtccacggaggcagctccccttcagctgttgccagaaaaccggggaggaaagaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatca

SEQ ID NO: 17559 - DNA, 1191 bp, Homo sapiens
  ENST00000532942
agaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttc

SEQ ID NO: 17560 - DNA, 1658 bp, Homo sapiens
  ENST00000506388
actgcgaagcaggcgacctgctcgccgcccagctccagggagaggaacccgcggaggagaggatcccggcccaggtggggaatccagctgctgcctttctcaaaagaccctcaaattatttctgctggaggagtgtcttccaggaaggactaatggtgcagctccccacagcaccagctctccagctgcccccacacagcctgttttgtgctagggctatcgcgatttgcaaattccttctctagctcaagtgcatggacccagaaaatgcccctgcttgagggccaatgttgaccaaggccctcagcagtaatgtgacctctgtgggagcagcacctcgcagagggcagagtttggctctatgcttgtaccattggtggtaaattctgctgagctctatggatccatctggatgaaaaggtctgtataaatgcaagatcattatcatcatcagctgtcccagttggagcctactgattctcaagcccacagtcaatggggcctttccaacaattccattgtacatggcttggaaaaggtgtaattacacgaagctgaatatcttctggagagacagacacgttcatgtctgtcccaggagtgttggagaggaatctctcaggcctctcattaggcacatggagagaggtgccctccaggcctggcccaggtcagggacaagtcagaagctacatctggagcagatccaggatcttatcctggtgcacacgaggggccagcatcgtgcttgcacatttatagctcaggtgctctctggtgttaccaggaagctgctgggaagagacggaggccggagagtgtcccaggacaatgcttccttcactcatgttcatttttaactttaaaaaatggcctccatgatccccaaaatggtcttttggtgtgagggaagtggttgctgtaaggaaagtctctgctcgacacacacaaaaattctcctccatgactttggaccatgtctctgataaaaagactggctgggtgaggagtccagcctgcagacctcccatttgtcctgagtcctctgttgcagtggtcctcaatccccaggttagggatcagtaccagttcctcttaggaactgggccgcacagcaggaggtgagcagcaggccagccagcaagcattgctgccagagctccgcctcctgtcagatcagtgatggcattagtttctcgtaggagcgtaaaccccattgtgaactggccatgtgaggtatctaggttgcatgctccttatgagaatctaactaatgcctgatgatctgaggcggaacagtttcatcccaaaaccacccccgcccactgtgaactcagagagcacctcagcctatggtcaggtaccatctacagcacttgtgccttaaacacccatcagcagatatgaagatttcccaaagcatgcctcaatttagggttgtgcaaactagtgtagcctcttgcctataaatgaagactaagggctccatccaaccagctcgcttgtctgggtccagtctccagaactcttccagcttccctgtagtaaaagaacacaccttggtgggcattgttcatttatcagtgcacagggccacgttgacaaagtcttaatatttaatggcttacgagtctaataataaaaaaattaaaactcta

SEQ ID NO: 17561 - DNA, 635 bp, Homo sapiens
  ENST00000530146
gctgagctctatggatccatctggatgaaaagggaacttatatttgtcagctttgcaagtggggctcagtttcggggaaggggtgagagagaagaaaggaagaaactgatgaagagaatgaaagaggaaaagacctgcctgacacctggatcttagaaacaaacctttcctaacaacagacctccaagcataaagagagtattttcaaacaactcaaaaaatcagtctaaatcaacgatattcaaaaggacaaagaaaaaaataataggggattatgttcttttctcatctgtcttatgttctgaagttattcatttgacaccttctgctcttgtacgatggcaggcctgtattcccaaagatgcccattccagccatctattgctgtgtaacaaatgacgacaatgtatgatggtttaaaatcacaactattttatttcatctctcaatattgtgggtcagagttcaggcttggtgaagtgattcatctgctccatatggcttgaacagtggtctcagagtggtattctgctggtgagttggctggtttcaagggtctaagtgaagtttagaggcttcactcacatgtctgcaccttggcagggatggcttcaaagatggggtccactgggact

SEQ ID NO: 17562 - DNA, 2572 bp, Homo sapiens
  ENST00000054950
agccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatc

SEQ ID NO: 17563 - DNA, 494 bp, Homo sapiens
  ENST00000532721
ttgctggagggccccgggaccccagcttggagatcgccgccgccgcgccccggccggggtggtttctcgcggggaggcgagaacgtggcagcggccgcgggagccaggacggcgagggcccgccccctcccccaggttgcatcagaagggaggggagagtgcacaaaagaagagtttgtccacagtggcctgaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagc

SEQ ID NO: 17564 - DNA, 2416 bp, Homo sapiens
  ENST00000533898
gtgctgtgtccaccatctggtgtcttcttgctttacgtttcaagtctttgtatccatggtggtgggatttaaaaaaaaaaatcacttatcttttgatttacatacagtttccactttttgccttggacctaagccagaagacatgagttctcaccccagttttaccaaatactggctgtgtaatcttagaagttattccatttctctgggcctcagtttccgttactccaaaatgagggtgctggactacagcagggaagattaataggtttcatcttacagatcagctctgatccgttgataatggccatcaccagagcacagtgctgagaattctgagagcacctctaggtttatcaggacagaggggcacgatccattagcagtgtctgccatcagcactggttgggggaaagcacatcaaccttggaaggataaacttgaagattccttccagcctccttggatcattgattctgttgtagttgtatgtgcattttggattgtgcaggtgtttgatcttttgctggaccagcatcacacaagccttgataatataacagccttgtgcctgtgtgtgggtttctttttttttttttttgtactgcaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggatttt

SEQ ID NO: 17565 - DNA, 714 bp, Homo sapiens
  ENST00000532474
accttttgcttcctaggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgagttaggtctctggattggttgtcgcctttcctaaagctcaggagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtata

SEQ ID NO: 17566 - DNA, 737 bp, Homo sapiens
  ENST00000527337
ggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgacggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaac

SEQ ID NO: 17567 - DNA, 2653 bp, Homo sapiens
  ENST00000531345
tctttacagtgaatagggagagggaggtggaggcgttgcgcttgaaaatcgaatacctagtgactcacaggcagaggaaacccaatgtattgactcgtcatttcacttctcggggaggcttctcttcaagcggcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgcttcattcaccacctgacatttccaagctctgcttccgtgacagagaaactgcctgcagggtatctctcttttccaagagctactgacacacacacaatgcaaaaacgtttcctttttcttttccttgccattttgtacaatggggataatgacccatcttgtagaattgttataaggatgaaatataatgacaagtgaaagccctttggaaatgatataaacaatagtactaaacacagtggctaagactctgggttgaaagcagagtgaccatgttcctgtgcagcctccagctcatatgagctgtgggtcattgggtaagactttacctcattgttttcatctgtaaaatgggaattataacagcactcactttgtaaggctgttatgtgaaaatcaaatgaaaactgtgtgtagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaagg

SEQ ID NO: 17568 - DNA, 549 bp, Homo sapiens
  ENST00000528630
gaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttgtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaagga

SEQ ID NO: 17569 - DNA, 6347 bp, Homo sapiens
  ENST00000394885
atataggcctcctcctggcgcgcctccgcaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaacagtagagctcagtatcaattttactgaaattaaaatcatacttgataagcatgataatcaattttaacctaattcagcaggtcaacttatttaactttggtggaggtgggatagggaaaagtgaagggaggaattaatttttttctagttctgatgtacagagattgtttttcattcttttttttttttttttttttgtgacagagtcttgctctgtggcccaggctggagtgcaggggcactatctcggctcactgcaagctctgcctcctgggttcacgccattctcctgcctcagcctcccgagtagctgggactacaggcgcctgccaccacacccggctaatttttttgtatttttagtagagaccgggtttcaccgtgttagccaggatggtttcgatctcctgacctcatgatcagcccacctcggcctcccaaggtgctggaattacaggcgtgagccaacgcgcacggcctctagtttttcattctttaaatcacttttatttgtgggtgaagaggtcagctatgcattctcttaatcactttccagcctaaagttgtctcatatacagcacactgggggctcaacaagtacctatgactatttgagaagacatgaaactcttctctgatagaatcgactgcacctatatacctctctactgccgcatctttgctgatgtgaggtgtgcttgcaaattgtaagcttccacaccttaatgactgcttgcttgggtatctacatggttttcattttaacctacactatatgtctggctatagcagttttagaattacagatttaccactatcactcatctgtcatttgtcagactcactgaagctggcatatttgaaatcaccagtttgactagttaactatttgtttttctctctagcttctccaaaatctatgccagaatagatcatcagatatggattatatttcaatcctttgcagaaatgcaatgtctgtactactttccttcctagcataaagaaaactacacttcccagccctcttgtaggtaggcgatggctagttctgaccagttaaacatgggtggaagtagtgtgtgtcactatcagactatctcatgacaaacccttttcctctgccacagcactgtgcaggaggcctcagctgaaatggtgcagccacaagatgaaagtggctttgatcttgagtctgtgtaggtcagctggatccacagtgggctttgtatgatcaaaaaataagcttttaattatgttaagccactgagatttggttgtgcttttttgtttttaaccacagcagagcccatcctgctgtgactgagtgaagatttcacatttaacaataggcttttaataagcatgcagagaaaaagaatcatctgcttgaacagagatgctatatctactgctgagtcaaaatagaaaattttaaggctttttttagatttgaattttaaataagacttttaaaataaagcttttattttggttttaatataattaggataatttgaatttatccttgagcatgagagtaaaaatagtttgagactttctgaatcattggctgattctgcctgaaggacttaatgacttccattatttgagttcaggtacaacttcaaaggggaaaattgaatgggatgtgcacatgttggctcatatgtagttctgattgggccaatttgcaggacagaaaatgatgtctagattatgatataaatttaaaggaagccaggacgttcagaggaaaagctagcatatcatgtttgccttacttagttctttcctttgcagttttaaaaataggctttttttttttttagtgtagttttatgttcacagcaaaattgagcaaaaagtagtatagagagtttcaatatgtcccctgccccacatacgtacagcctcccccactatcctatcctatatgtcatgagatagtacctaccagagtggtacatttgttaaaatcgatgaaactgttaacatatcattgtcacccaaagtgcatagtttacattagggttcactcttggtgctgcacatgctctgggtttggacaaatgtataattacatattcccaccattgtagtgtggtagaatatttcccttgccctaaagtctttctgctccacctattcatccctcccttccctgtaaccccaagcaatactgatctttttactgttcataattttttagattgtagtaaaatacacataacaaaattcatcttaacagtttttaattgtacagttcggtggtatggtattaaatacagtcaaaatgtgaaactattaccaccttccatctccatgaacttcatttgtaaaacggaaatttatacccattaaacaataaagccccctttccccttcccttcagcacctggcaaacaccattctagtttttttgtttgagatggagtcttgctcttgttgcccaggctggagtgcaatggcatgatttcggctcactgcaacctctgtctcttggggtcaagcgattctcctgcctcagcctcccgactaggtgggattacaggcgggcaccaccatgccccctaattttttgtatttagtagaaatggggtttcaccatgttggtcaagctggtctcgaactcctgatctcaggtgatccacctgcctcagcctcccaaagtgctggaattacaggcgtgagccaccgtgcccagcctcccattctagttttctttttctttcttttttgagacggagtctcactcttgtcatccaggctggagtgcagtggtgcgatctcggctcactgcaacctccacctcccaggttcaagcgattctcctgcctcagcctcccaagtagctgggattatagatgcccgctaccacgcccggctaatttttgtacttttagtagagacggggtttcgccatgttggcatggctggtctcgaactcttgacctcaggtgatccacctgcctcggcctcccaaagtgctgagattacgggcatgagccaccgcgcccagccccattctagtttgtgtctattaaaatagactcatatagtatttgtctttttgtgagtggcttcacttagcataacgtccccaaagttcacccatattgttaccagaatttctttcgtcaggctgaacaatactttattgtttgcatataccacattttgcttatccattcaccctttgatggacacaggttgcttccaccttttattgtgaataatgctgccatgaatatgggtgtacaaatatttctttgagatcctgcttttagttcttttggatatatattatacatagaagtgggattgctggatcatatagtaattctatatatatatatatatatatatatatatatatatatattttttttttttttttttttttttttttttttgagacggagtctcgctctgtcgcccaggctggagtgcagtggcgcgatctcggctcactgcaggctccgcctcccgggttcacaccattctcctgcctcagcctcccgagtagctgggactataggcgcctgccaccgcacccggctaattttttgtatttttagtagagacggggtttcaccgtgttagccaggatggtcttgatctgctgacctcgtgatccgcccgccttggcctcccaaagtgctgggattacaggcgtgagccaccgcgcccgactagtaattctatttttaatattttgaggaactgccatagtgtttcccacagcagctgtgccattttgcatttccaccaatagtgcacaagagttccagtttctttacatccttaccaacacttgctattttctgtttttttttttttcttttttttttttaatagtagccatcctgttgggtgagacgtggtatctcgttgtggctttgatttgcatttccctaatggtctgtctctacagttttgcctgttccagaatatcattcctttgcaatttaaatgtgaggataaatgtatgctattgtttctcaaacgtttttgtgttacaatacctccttttgagtgagaaatgtcaactcaaacttacactttttcacttaggaagatgatttaggaaagccacttagagtaaaagtttttaaacaactgtaaaaactaatttgcttcattgcaacatttgagttctgtcgaataaatatttggccag

SEQ ID NO: 17570 - DNA, 1750 bp, Homo sapiens
  ENST00000320963
cgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggaatttgccatttgtaaaaaacagtctttctgtttttggcttcttcgatttaatcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaa

SEQ ID NO: 17571 - DNA, 1366 bp, Homo sapiens
  ENST00000394883
gtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttga

SEQ ID NO: 17572 - DNA, 691 bp, Homo sapiens
  ENST00000557805
ggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcatcaatgtggaggtttggggctccatcctcagagccagtctgcttagcttcacatttagctccagcacttcacggttgtgtaactttggcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaa

SEQ ID NO: 17573 - DNA, 3936 bp, Homo sapiens
  ENST00000558598
ttctagtatcacacattatatatttcctcatgtagaatcattagtctaccaaaagatggcagttttgttcctcacaagtttctgttgtaatctaaaaataaatgattatggtagcttttttattactgtacctaacactttttaccctctactagaatacaaagtttttatatacaagaaaaaaaaagagtgttgaagttttatgaaactgaccatcttttttgttatttttttaggaatttgccatttgtaaaaaacagtctttctgtttttggcttcttcgatttaatgtgagctattcttattttgtgttcttcaaatggccgtgaaatgtgaaccagaaaaagctacccccttcactttttttttttttaaagaaatctcagcttgttgaaagagatcctttctttccataggcaaatttggccaaatttagctcttctcctgaaacatggacctttttgctccaaagtgaagggttctttcataaggaaatcaaagcacttggtattttgaataatggtttattcaaaaagaacttgattgactcagcaaagtacctcaaattcttgtttgtctgcttttaccatgttaaacctgaacataaaatgcaaattatttggtctagttatttaaaattttgaaacattaagttaaaagctatttggaaacaagttattattttttcttttctgtcatgattgggtgaatataactggcttgtagagtctgatgttaataaaacaaattctttggggaaagaggtgagcctctccgctgtaaatcagtaattgtaaaagaactagtgtttaggtaaatgactgctacctgacctctattattctagaagactgaagagggtatttttattcagtagtgaaacacttaaaagcttctaaaatatttgaaattgtgctttaaaaaaatgcacagtttaatacatatcagtttataggaaggaaagctattcccagaaattctcaaaacagaaattatgcaggattagcagtatagcattattggctcccaaggctcttggttacagaattaccattgaaaattttatcaaaagcagccttgtccctgatagctgccgaatcatttttaaaaaggggggtggatgggaagatgggagagaaagtagaaaaggatatgtgtttattaaaccttaacatgggatccatttaaacttttgatgttatttatatctgaatatacagaattaacactataaagagcctgctaagactagacttccaggctgagcacggtgactcatgcctgtagtcccagcattttgggaggctgaggcaggtggatagcctgagctcaggagtttgagaccagcctgggcaacatagtgaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccaccccccaaaaaagaaaagatttccaaatattaggtacatatactaatattatgagattctcaacataagaagactgtttttctgaaacaataatgtatttttgaaaagtcacttagaggaccagaaacattttttaaaagccctaccaagatttaatacatggtataaagttattgatttttgggcattcaaaaaagtattgagattaattattaaagtagacagtatagtactgtagaaagaatagggaggatccaagttcagtagttttgtttgttttttgagtcagggtcttgctatggtgtgaaggctggccttgaacttctgggctcatgcagtcttcccaagttgctggaactacaggcgtgcgccactatgccatgctcagtattttttagctgtatttctgacttttatcaaatcattcaatctgcttttctatcaataatagtatataacactaaatacttaaggtttattaatggtgtggtagggattctcatcccaattgcttattagagatttttatcccagtttgatagatgaggaaaccagagaggttaagcagtttgcgctgacaccacagctagtaagtggcattgctggaattcaggtctgggtctatatgactctagagcttgtgagtctatcctgcccctaatacatgtatttgtgtagcttaccttcaaagggacgatgtgaagataaatgagataacggatgggaatgtactttaaatttcacatagtttgtatttttcaaagtatttaaaatgatgtggtatactaatgagaaattttaattttcaaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaacaaaatcctgtgctgttgcaggtggatcttaaaagagatagaaacataaaacactacaaatactggtgtaaacacagtatcagaagcttagtagaaggtgaataagtgtttgaaattaagagtttgcttttatataagcagctgttttttcagaattgttgcttaaagacaccaaacaatgccatttttaaattggtcaccagttttacttattctgattgtcactttaaaattacacatggcattactttgtgaaaacatgtaagaaactttgtatagaaacatgatatacagtaaaacattacccacctcacatctgggaaaactagatatcggaacaaatagcagttaacaaaattactagtttgtgaaaacatccaatgattttaaaactgggttgtttagactcgtgtcacttttgaaaatgactatatatttgttcttatgtcaggacttttcagttaagtagttctgttttattgggctttctttagtaaactttaaattcacttcctttattctagggatataccaaacttcttattggatacatgtgatattcttgtgtatgtatatttgtgtttttttatattaagctgcaaatgaagatccagaatggatacttgttgagaaagacagattcgtgaatgattatgacaaagataacgatggcaggcttgatccccaagagctgttaccttgggtagtacctaataatcagggcattgcacaagaggaggtaagtgttacagaacaactgtttctctccaccccctccccccgaatttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatg

SEQ ID NO: 17574 - DNA, 683 bp, Homo sapiens
  ENST00000560833
aggaaaccagagaggttaagcagtttgcgctgacaccacagctagtaagtggcattgctggaattcaggtctgggtctatatgactctagagcttgtgagtctatcctgcccctaatacatgtatttgtgtagcttaccttcaaagggacgatgtgaagataaatgagataacggatgggaatgtactttaaatttcacatagtttgtatttttcaaagtatttaaaatgatgtggtatactaatgagaaattttaattttcaaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggtaagtgttacagaacaactgtttctctccaccccctccccccgaatttggtgctgttgatag

SEQ ID NO: 17575 - DNA, 4888 bp, Homo sapiens
  ENST00000377966
gatgaacccttgtcagggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatg

SEQ ID NO: 17576 - DNA, 1128 bp, Homo sapiens
  ENST00000475774
ggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagcattcatggattttaccgtctcagctatttgcagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaa

SEQ ID NO: 17577 - DNA, 1717 bp, Homo sapiens
  ENST00000479053
gcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatatgtttgaattttttgccaatgagcaattattacttttgtaattaaaaagtcataacaatgagaagagagcctgatatcttttaaaaattagggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaataataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaagatgaaaagaaagaaagacttgttttttgtaactcagtagcagtactgtgtgccttgtttggccaccatctaaatcagaactctaatggcttttgacatcctttggtgtagctgtgtggtcaaaatcagaggatgaagcattgccccaataaccttcatttgttttaaaggcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtca

SEQ ID NO: 17578 - DNA, 3857 bp, Homo sapiens
  ENST00000165698
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaa

SEQ ID NO: 17579 - DNA, 1702 bp, Homo sapiens
  ENST00000538924
agtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcagtgtgtacctgctgctccacctgcaggacctggaaagtggttgagggagatgtgaatgagggtggtatgaaggcatgggagccccaccaggtccaaaacccattggcgttttctgacgacgaggaggaagacctgctggatttcatgtacaagtataaagcacctcgaaggatggaattgcccctggaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggg

SEQ ID NO: 17580 - DNA, 1196 bp, Homo sapiens
  ENST00000535845
cagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgc

SEQ ID NO: 17581 - DNA, 969 bp, Homo sapiens
  ENST00000541910
gggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggc

SEQ ID NO: 17582 - DNA, 940 bp, Homo sapiens
  ENST00000453231
gtttcttatgcagaaagtgctgagcaacggacagactgaagaggttaggtctggatccaggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctga

SEQ ID NO: 17583 - DNA, 566 bp, Homo sapiens
  ENST00000490915
gttttcaaagagaggcgttggggttgtactgtgtgtgtgcaagtgtgtgccctcaccttcataggtggaggacagaggaatctgggaaacttgcagccacatgcaagcaggagaggcgtccttgccacccaccgggtctcatccttcaaaagggcagtgttgctgagaacctaacagaacttgtgttttcatctctctctccaggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaac

SEQ ID NO: 17584 - DNA, 576 bp, Homo sapiens
  ENST00000473407
cttctcccccgcgcccctccgtcccctccctccccgcccccggccccgggctgcgcgcgcccctacagcgcccggtcccagtggctcgggctattaatacccggcgcagctaaatttagcaggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagac

SEQ ID NO: 17585 - DNA, 958 bp, Homo sapiens
  ENST00000489855
attcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaaggtactgtgctggaagtaccacaactacatgagtctcagtccctctagtgtgccctgctcatcacctgtgcgaccacacagaacaggctaaggaccaatcagtggtttttcatcttttaggggtccttttgaaaatctgatggaaaaaaatgctgaatcttgccccagaaaattctcaccccccaacacacatgcccacatacttgcaatatcaagaggttcccagagcccctgaagctcatctgtgcgtcccaggttaagaatttctaacttatccaaccccactggaaacaagaaaataatagaatttctaacttacttggcacttaggcctgggagaaacagaagagggcaggggagagagggagagagtgcttctctgcagtttcctagggtgcactgggagagtcgcctaaatgcagtggacaggtggagagactacctgagcaagcgggtggactcactcacgatcatgtggcccagcagatccaggggaaggaacccaggtcctagaataagttgagtggtccagacatggaggtcagtaatgtgccaagccataacaactgaagtggaggaggtttgaaataaacaccagtctgtggg

SEQ ID NO: 17586 - DNA, 465 bp, Homo sapiens
  ENST00000475475
agcttttgtcaggtggaaaggacagcgcagacgaaccaggggcgctgcctggagggtcagcgcggaacgggtggagaggcagaggcggggctcccagtggggttggaaaaatcctcctttttaggtgtctgcatcgacagcggcaaaggcagctgggacatgggaagacgcatgtgaatcttggagtaaacgcctggagcccccggctccgactccttttgcaggggattgagagacaggggcaggtacctccaggaatgcacgggaaattttcaagtgacagccacccgcatggtggcgatgacacctcccaggccttgcaggagagcgcagagtcatctagggcttatatttggcaccctttaccctgcgtattattcctacaaggctgtgaaatcaaaggacattaaggaatatgtcaaatggatgatgtactggattatatttgcacttttcaccacagca

SEQ ID NO: 17587 - DNA, 11571 bp, Homo sapiens
  ENST00000424685
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctatttagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 17588 - DNA, 688 bp, Homo sapiens
  ENST00000473945
actttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctttcctgtagaactggaatgcttatgtctcgacgggttcggactgatggctccaagtggttggcaaggagaggtgaatcttctcggtagataggttcaaatgttcattctgtttaccaaatccaaaatgaaatcagtcccttggctgatttcagtcaatttgcaagcaaatttaagtgattaattggtaggaaaactaccagatttgttttggttcagtcatagccatgagctgaattttccagtcttgagctagccctcgtcttagttttcactgaggcacctgcttgcatggcatccatatcaacccccaaatccaagagcaacctggt

SEQ ID NO: 17589 - DNA, 612 bp, Homo sapiens
  ENST00000478148
aagagcattctgaaaggcccctcacattctgctggccgtccagtgccagttctgagcaggccaacagatcaaaacaaacaaacaaacaaacgaaaaaggcagaactttccatttcttaaaactaaatggaaaatttgggattttttaaaaatacatttcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaac

SEQ ID NO: 17590 - DNA, 641 bp, Homo sapiens
  ENST00000473457
ggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttggctggagtgcaatggtgcgatctcaactcactgcaacctctgcctcccgggctcaaacgacacattttctatttgatagcctcagatgcttgtttttacagatgttctttcttagtcctggagactttaaagaagataaacgattaaagcaaagaaggtgtaaagatgtagaacaaaatgagatttcttagaattttatgcttctgaacatttaaattgacctgaattgacagtaattcaaactgatcatgtaccgtaaactatatccttcaagtttgtatagaagagttttttcctaacacttctaatataacaaagaatcatatcatgaatgcaagtcctgtatcatgtttattttcataaatagttagcatctgctcagataaatgcaaaagttgctgagcattttaatttaacacttgcattgaatgcatgataacagca

SEQ ID NO: 17591 - DNA, 891 bp, Homo sapiens
  ENST00000429186
tactgcgctggtggcaaccacgccacaatggaacaggtcatgatcaatgggctttggaccatgtggaggtcgtcctagatgaaaaatcctatattgcgtctaaacctgatcagacttttatgactaatcacagtgctgcatgcattgaaaggcattttttaacttgtgttatatttcattatttgctgtcattggttttccactagagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaaga

SEQ ID NO: 17592 - DNA, 11565 bp, Homo sapiens
  ENST00000343529
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 17593 - DNA, 11571 bp, Homo sapiens
  ENST00000428762
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 17594 - DNA, 1078 bp, Homo sapiens
  ENST00000310791
cgtctgaaccagattcacatgtttgatatttggatgcagagaaaatggggcagaaagcatcgcaacagttggctctgaaggacagcaaagaggtgcccgtcgtctgtgaggtggtcagtgaagctatagtccatgcagctcagaaactgaaggagtaccttggatttgaatatcctccaagtaaactctgcccagctgcaaatactctgaatgagatcttcttaatccatttcatcactttctgccaagaaaagggagttgatgagtggctgaccaccaccaagatgaccaagcaccaagccttcctgtttggtgcagactggatttggaccttttggggatccaacaagcaaataaagcttcagctcgcagtacagactctgcagatgtcttcacctcctcctgtggaatctaagccttgtgacctttccaatccagaatcaagggtagaggagtcttcctggaagaaaagtagatttgataagctggaagaattctgtaacttaataggagaggattgcctgggtctgtttatcatctttggtatgccaggaaagcctaaagacatcaggggagttgtcctggacagtgtcaaaagtcagatggtgaggagccatctgccaggagggaaggctgtggctcagtttgtcctggaaactgaagattgtgtgttcatcaaagagctgctcagaaattgtctgagtaagaaagacgggctgagagaggtgggcaaggtttatatcagcattctctgacttggatatgtattatgtgagtggcctgtaagaggaaaagaaaaaaagattctaataagcaagctcacctatttgcatcattccagcatgggattttttttcatttgttttcccattgattgaaaatgattactgggatcaaagtacattcatgtcgcaattacagagagagagagaaaaaaagaaaaccctggctctgcctatgatttaaaaacagttcaggaaaagttataatttagtttaatatttcattcacttattcaataataaaaatggaagagagataataaagtcacatttaaagtttgatttgcaaaaaaaaa

SEQ ID NO: 17595 - DNA, 583 bp, Homo sapiens
  ENST00000519397
agaggaagcccagcaacttctgctctttcttaatttctagaaaagagtgaagagaggccttttcaaagttcgcaggatcgggcctttttgtgctccactttggaacaaatcggaagctagggccttccagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgctt

SEQ ID NO: 17596 - DNA, 464 bp, Homo sapiens
  ENST00000487455
aaaagagtgaagagaggccttttcaaagttcgcaggatcgggcctttttgtgctccactttggaacaaatcggaagctagggccttccaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagg

SEQ ID NO: 17597 - DNA, 3182 bp, Homo sapiens
  ENST00000479668
ctttttgtgctccactttggaacaaatcggaagctagggccttccaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 17598 - DNA, 1022 bp, Homo sapiens
  ENST00000466559
cggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccac

SEQ ID NO: 17599 - DNA, 2058 bp, Homo sapiens
  ENST00000489432
ggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctga

SEQ ID NO: 17600 - DNA, 1192 bp, Homo sapiens
  ENST00000475514
ggacgggcctggcagttgtgaactcgaacctgccgctgtcgccgcggcggggcggggagcgagagtgggccgcggaggccggccttcgggctccatggacgggcgccgcgtccctgcacagcccgccgcagagttttctctaacacctgggggctaccggagtgtgggccgaagcaggcgctgcagccgcggaagtatccccaggaacatccccaagaggagctggaaaaagcctcatccccagctctgcagtctccaggaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctg

SEQ ID NO: 17601 - DNA, 1064 bp, Homo sapiens
  ENST00000473391
gacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagccttccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctct

SEQ ID NO: 17602 - DNA, 1029 bp, Homo sapiens
  ENST00000482680
cgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgccc

SEQ ID NO: 17603 - DNA, 1262 bp, Homo sapiens
  ENST00000488943
agttgtgaactcgaacctgccgctgtcgccgcggcggggcggggagcgagagtgggccgcggaggccggccttcgggctccatggacgggcgccgcgtccctgcacagcccgccgcagagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagc

SEQ ID NO: 17604 - DNA, 672 bp, Homo sapiens
  ENST00000495535
gtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggagg

SEQ ID NO: 17605 - DNA, 899 bp, Homo sapiens
  ENST00000467980
gccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccc

SEQ ID NO: 17606 - DNA, 910 bp, Homo sapiens
  ENST00000469309
tgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagccttccttcctgcaatgtcctaatttgtgtgggtggaagagggcaggcgggcagaat

SEQ ID NO: 17607 - DNA, 478 bp, Homo sapiens
  ENST00000518514
gagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttag

SEQ ID NO: 17608 - DNA, 480 bp, Homo sapiens
  ENST00000522266
ggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgccc

SEQ ID NO: 17609 - DNA, 621 bp, Homo sapiens
  ENST00000518462
ctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccagg

SEQ ID NO: 17610 - DNA, 824 bp, Homo sapiens
  ENST00000486714
cttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccat

SEQ ID NO: 17611 - DNA, 2876 bp, Homo sapiens
  ENST00000425389
gggaggggagaaacaggggcagagtgagttggtctctggagtgactgtgcttttccaccctcagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 17612 - DNA, 3292 bp, Homo sapiens
  ENST00000397281
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 17613 - DNA, 2969 bp, Homo sapiens
  ENST00000444957
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 17614 - DNA, 2264 bp, Homo sapiens
  ENST00000256953
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 17615 - DNA, 2060 bp, Homo sapiens
  ENST00000538313
gaattcccaaatttcttttgtttaaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcat

SEQ ID NO: 17616 - DNA, 2134 bp, Homo sapiens
  ENST00000536465
attggagttgactaatatgaatgtatgttattcaacccaaagagacatgaagaggcccaaaagtgactctctccattgccccactgcatgtgtttgtacactgaatgcttacagatagatggtaaatgattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtga

SEQ ID NO: 17617 - DNA, 1383 bp, Homo sapiens
  ENST00000546331
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctagg

SEQ ID NO: 17618 - DNA, 574 bp, Homo sapiens
  ENST00000545567
aaatgcgaaagaatgacagccaggtatatcatattcaaacttctcctcagaaattatgcaagcaagaaaagagtgaaatgaaatatctgaagcattttgacaaaaagaaaatccaccgacctagaattctataccctgaaaaattactcttcaaaagtgaaggataaattaagactttcttgggcaacaaaaattgaaggaatttgctgccaataaacctgccttgaaaaaaaaatgatacgatacattcttcagagaaggagaatgatacatctcagaaactggattgtacttaaagaaaggaagagcattacagaaaaaggtaattttaaagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 17619 - DNA, 935 bp, Homo sapiens
  ENST00000537647
gccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaaaatatttttctggatcaaataaaactgagaaatctatgctatgaacaaaaataaggcacttttcttcaactaacttttgcatgcctaaaacctttttctctaattaactagccattttatatattaacatatttgtaaatatctgtatattcatccttatataaactgcccagtgtttcaagggggttttgaaaatactataatattcacatatcatctaggttagactctctcacctatattttgtggcatagcaagatattaataagttttcatggtcaaatgtgttttgaaatgctcaaatgaagttaaacaggtgtctttactgaaagaattctcagagcctctaacaggcttgtgtgtgagtctttaagaaagagatttagtatatattgt

SEQ ID NO: 17620 - DNA, 655 bp, Homo sapiens
  ENST00000393736
ttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggaagaggtaaccatccatcacggttttcccagaacaggctgatttgcgtcttctgtcctggcataaggatcccttcactctcggaagtgttccggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccct

SEQ ID NO: 17621 - DNA, 582 bp, Homo sapiens
  ENST00000537717
gcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcaggtaagattttcgttgtggttgttatagtgtgtgtgtgtgggtgagtgtgtttctttattactgtttcttgggattgggcaggtgagtagttggtattcctcctattttcatttcttactcttttagataaagtctcttcatctagaacttttattttgcgtaatcgactgttacgtatccttttgcttatttatgctgaagtagctttgctgataacacacaagataaaggatatatcagaggtcttggcattctgatttttaacaacctccaaagaaatcagatgatggaaattaaaaaatatatatttgttcttttctctatgtatgagat

SEQ ID NO: 17622 - DNA, 562 bp, Homo sapiens
  ENST00000437578
atctgggactacgggcgcccgccaccacgcccggttaatttttttgtatttttagtagagacggggtttcactgtgtttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggtaggaccattcggtattcttgagaaacactggctaatcttctagtcgacaaagtcacacccaaggaaagcaccaaacttctctgaggtcaatattatgttggattgtgcagagcctgttccataaagatctttatgtgcccaacaagctgcag

SEQ ID NO: 17623 - DNA, 5659 bp, Homo sapiens
  ENST00000355710
ccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaa

SEQ ID NO: 17624 - DNA, 729 bp, Homo sapiens
  ENST00000498820
cgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgccc

SEQ ID NO: 17625 - DNA, 4149 bp, Homo sapiens
  ENST00000340058
ccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattt

SEQ ID NO: 17626 - DNA, 773 bp, Homo sapiens
  ENST00000638465
ggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaa

SEQ ID NO: 17627 - DNA, 608 bp, Homo sapiens
  ENST00000640619
ggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcacctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatctt

SEQ ID NO: 17628 - DNA, 577 bp, Homo sapiens
  ENST00000479913
acagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcaga

SEQ ID NO: 17629 - DNA, 4337 bp, Homo sapiens
  ENST00000615310
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatc

SEQ ID NO: 17630 - DNA, 616 bp, Homo sapiens
  ENST00000607320
gtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaagttacttacggcaataaatcatctatgagttagtgcaccgtgaggattgagtgtttatcgtgtcactaggaacagtcctggcctcatgtccaaaggattccagcccacaccccccattcactataagtttctaactcctggcagcatgatgacgtggtggaggaagacaaagttcccatggaaagctgcagagccagctaggcttgctgtgctttctcgtcatttgtagaaagagatggcaagtggaactcagatgccaccagtttcttcacagctctgagcatcaatcgcctcaagtgtgaaatggggtgaaatggcacccacctctttggatttttgtgaggattaataagatgtgaataaagtgcttggtccatggtaa

SEQ ID NO: 17631 - DNA, 2695 bp, Homo sapiens
  ENST00000432519
ctcgtacagtccttcatcttcatggcagaaaggctgttctgcccctgcgccctccctggcctctctggggatccctgcagctgatgtattgtgatggagcagtggacttggatgctgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagtgcaccgtga

SEQ ID NO: 17632 - DNA, 2982 bp, Homo sapiens
  ENST00000334133
cgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtta

SEQ ID NO: 17633 - DNA, 1314 bp, Homo sapiens
  ENST00000483671
gtgattattgattgctgaagaactgagctataaatgaaggaaccaaaagctcagcgcctcatcccctgtgccttcttggctgtttggaccgacctgccactccagaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagg

SEQ ID NO: 17634 - DNA, 1137 bp, Homo sapiens
  ENST00000451036
atggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcaggg

SEQ ID NO: 17635 - DNA, 569 bp, Homo sapiens
  ENST00000495666
agtttgtcttttgactttgtttatgctgctttttgccacctagtatttttatatttgctcaatcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggaga

SEQ ID NO: 17636 - DNA, 513 bp, Homo sapiens
  ENST00000484752
tataaaagaaacttgctaggccaccaagcacttggagctttgcaggatatcttgtagttttactgaacagcaaagccttcactttggctttcttggttcctgaatcttctgtgtgctgtggtgggtttaaactaaattgaagggcttcaacatgaaaaagttcaaagcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctca

SEQ ID NO: 17637 - DNA, 566 bp, Homo sapiens
  ENST00000470458
gagttctcatcaatgcctcctggtccagtcctcccaccatacacctgtcagaagttcctgcacccctttgggctcctccagcttaacttctttaatgctgtgtcagctgttagggaaatgggaaggaagagaaaagaaaaatggtgaatgcaaagaaccatattcaggaggtgcttggtctctgcttacaaaggctgcagcgagacccccccatatgaagatgctatcgaggattatgtcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaat

SEQ ID NO: 17638 - DNA, 578 bp, Homo sapiens
  ENST00000449415
gaggtgctggacgtgtaggagcagacatgccgcgcgctccgaggaagcgccggaaccaccagaagcacagggacgcgggtgccgagagtccccagcactgaaaacggggatctcctcttctctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 17639 - DNA, 599 bp, Homo sapiens
  ENST00000441460
gggtttgctctggggacagaggtgctggacgtgtaggagcagacatgccgcgcgctccgaggaagcgccggaaccaccagaagcacagggacgcgggtgccgagagtccccagcactgaaaacggggatctcctcttctcagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 17640 - DNA, 577 bp, Homo sapiens
  ENST00000453536
ggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacaggaaatcacatctctgccagtagtacccttttattctcactcctttcagaaaattcctttggaatggtgaaatacagcctctcaaatctccagtgctctgtatctcagaaaactgatcttcacaatgaaggctacatcttggaattagattgctgtt

SEQ ID NO: 17641 - DNA, 555 bp, Homo sapiens
  ENST00000431547
aaatcttgaaggatccttgtctcccaggcgctcttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaa

SEQ ID NO: 17642 - DNA, 3955 bp, Homo sapiens
  ENST00000392842
atctgacgagcggccattcatcaggccggctggcctatcaatgacattgctcccatcggggctcctataaaatgatgctttttcccatgaaacatccgcaaacattttgacgggtttggctttgcccggctggattactgagtgtccccttgctcgctcgctttttctctctcccccttctccgagctcgctcccttctctccctctctctcctcttttcttctttctcttttctttcctcttctttttcttttcttttcctttcctcctttatccttgtgccccctcactttctgcgtctctctctctccccttctccctccctccctcccttcctccctgggcatctctagcacaggggatccccaaacatcaggacttttggggggcgcctgtgctgtccatgggaagagcatgcattgtgggttactggaggaacccgacatggattccacagagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacg

SEQ ID NO: 17643 - DNA, 660 bp, Homo sapiens
  ENST00000546882
cggctggattactgagtgtccccttgctcgctcgctttttctctctcccccttctccgagctcgctcccttctctccctctctctcctcttttcttctttctcttttctttcctcttctttttcttttcttttcctttcctcctttatccttgtgccccctcactttctgcgtctctctctctccccttctccctccctccctcccttcctccctgggcatctctagcacaggggatccccaaacatcaggacttttggggggcgcctgtgctgtccatgggaagagcatgcattgtgggttactggaggaacccgacatggattccacagatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagcaataaatgagagttcctgttgctctacatcctcaccagcatttggtgttgtcagtgttccaggttttggccattctaatagatcataaggcagcagtttcctcagttaaccaccagaagactcgggacccgaggacagtcaaa

SEQ ID NO: 17644 - DNA, 473 bp, Homo sapiens
  ENST00000549040
aaagatgcgctggctcgcggcgagctcgaggtgccacttgcagaaactttgccagccgaccgccccctcccggacccaggtcctcctaggagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgat

SEQ ID NO: 17645 - DNA, 1053 bp, Homo sapiens
  ENST00000539967
gttattatatcattccgaaaggactggaacaaccgactcacagcaagtgctggggcgaagtaggaaacgtccaggataagagaggccggcgagcggggccaccgtcccttactcttaaaaggaaaatccccgcgaagtgcctcgggcccgggagaacagttttgcaggggccagggctctagtggcctgctttggggccacttcagcatgacctgcggaaacgcgcccctttgttccgcacactgagccaagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaat

SEQ ID NO: 17646 - DNA, 2565 bp, Homo sapiens
  ENST00000357881
gttgccatggcaacccactgacctgagccaccccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacagg

SEQ ID NO: 17647 - DNA, 1228 bp, Homo sapiens
  ENST00000536722
accccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccg

SEQ ID NO: 17648 - DNA, 2186 bp, Homo sapiens
  ENST00000536688
tggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccacacacacaaaaagccagacatcttggctcacacctgtagtcccagctacttgggaggctgaggtgggagaattgcttgagcccaggagctacgatcgcaccactgcattctagccttagtgatacagtgagaccttgtctcaaaaaaagaaaaacagggctttctggaaaaacattcttctcccacaatctccaaaagataatgccaaaacctgggtatcttcctggatttgtgaatgacgtacaggtattcatttattcattggtacacattctgtatgctgctgttttcaagttggcaaattaagcatatgataaaatcccaaaact

SEQ ID NO: 17649 - DNA, 1659 bp, Homo sapiens
  ENST00000552773
atgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaagcaccggacggccattccacctgcagagcgcacatctatgggcctcgagacaggccacacccttggctctttatcctgagctctgtctgcaggcctggcagaagtctgtgcctagagggaatatggaagagctttatgacggccagggcccctctctcaggactcctgaaagagaggttgtccaaaagcccaagacgagttggctctgctgctttaaggaatctgattttgtaccaccctgcttttaggcatattttgtaaaatagtcttgggcatcattgaaaggattgccttgtggcctcttggaggatcaccaggttatctggactgttttgctgagcaaactctgctctgatagtatgcagtagaccagagaagcaaaactgtactattccctgcatgggagatggggcagaaaggtccagctgcaccatggtccatgagggttcacggcttcccattcatcagtttcatcaagcaaccaaccaactcatgctttatactttctgtgtgtcacatatgtggtgctaggtactgggaacacaggagcaaatcagttgctgccctcatggagcatagattccggtgggaaacagacaaaacagagaatcagattgtgacaaagttgtagcagagagcaacaaaagaggaatggccagggaaggtctttcagaggaggttacatttaagtaaagactaggggagtgcagaaggctgtgcagacacttgtctgctaggtgtgagtcagtgggaagggaatctcttcctgtactgctcgaccttcattaaaatctgcatttataggacttgcctctaaggatgtttcaaaaattgttggacgataataggtgttccatgaagaagagcagcaggccctataagtttggttaacactaagtttaaacagtttcctttactgcaagacttctcagaacccttattatgctaatgtacaaggtgactccactagagggtgccttattatgcagcatttctaagcattttgaccacgttgagcaggtcagcacatagtgacctataaaacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaaggaatttccagaagactgttgaacaaaggacctcttggaataaattcctaataattttccaagatgactattctg

SEQ ID NO: 17650 - DNA, 798 bp, Homo sapiens
  ENST00000551640
tgccactagatgtgactgtgtccctccggatgacctcagctacagatggagaaaggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaat

SEQ ID NO: 17651 - DNA, 599 bp, Homo sapiens
  ENST00000552866
agagtgagttccaggtgggaaggcagttatgacagttgagaagtagtagaagacacggaaggcacagaaggcagacttcgctcagcacaaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgagatccagtccactgggagatcctgtcagctccaccttctgcagggaaacactgcatctgtccatttcatgcctaacttccaagccttagtgcttg

SEQ ID NO: 17652 - DNA, 3378 bp, Homo sapiens
  ENST00000229387
agagtgagttccaggtgggaaggcagttatgacagttgagaagtagtagaagacacggaaggcacagaaggcagacttcgctcagcacaaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 17653 - DNA, 594 bp, Homo sapiens
  ENST00000552917
ggcaaaatgaactgggctgccttcggagggtctgaattcttcatcccagaaggcattcagatagattcgagatgcccactaagcagaaatatcacggaatgtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctct

SEQ ID NO: 17654 - DNA, 960 bp, Homo sapiens
  ENST00000379359
gcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcttcct

SEQ ID NO: 17655 - DNA, 243 bp, Homo sapiens
  ENST00000487837
gaggtgtggtccctgcgatctgggccagccagcctctgggcccagggatgggggcgaagctctcaggtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtaagt

SEQ ID NO: 17656 - DNA, 7772 bp, Homo sapiens
  ENST00000566428
caagagtgcctgaggctggatcagaaatagccacgatcgtccagtttgattgattgattgattgatttagttgtgatggagtctcgctgtatttcccaggctggagtgcagaggcacgatctccgttcactgcagcctccacctccccggttcaagtgattctcctgcctcagccttccgagtagctgggattacaggcacctgccaccacgcccggctgatttttgtgtttttagtagagacagggtttcgccatgttggccaggctggtcttgaactcctgacctcaggtgagccacccgcctcggcctcccaaagtgttgggattacaggcgtgagccactgcccccagccccagcttgatcttgaacctcctgtgtgtgggcagagagacatggccctgctactgcttgaacggcttccggagacagtgacttgtttcctttttccctctgaactatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaaaaa

SEQ ID NO: 17657 - DNA, 1873 bp, Homo sapiens
  ENST00000567328
ttctggtgaggagtggcgctaatgtctgtgtctgtgtttccattctagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggtaaggccgagcccgcggcttcccgtcaccctcttactgacggggccagcagtcactccccgggatcacttctagctgcctttgtccccatcagaatggcagaattctcacactcaccagagtggcagaataaaaagatgaacactcacaggcgttggtgaggatgtggagaaactggagctctcctgtatggctaggagcaatgtaaatgagcagccgctgagaaacagtctggcagttcctttaaaggtgaaacacaagagttactctgtgacccagcagctccactcctaggagtcgcccaagagaaaaacatgtcctcacaaaaccttgtacacaaatgtctgtagcaacgtcgtttattatggccccgaggtggaaaccaccttcatggctgtccagtgatgaatgggtaaacaaaatgtggtccatccgttgcatggactattagccagccatgaaaagcaatggcatgctgctccacgctgtagcagggatagacctgggaaacatcgtgaaactcagtggaagaagccagacacagaagcccaagtattgtatcatccctatgaaatgtccagaactgcagattcctagagacacagcagatgacagattgcccgggcagagggtggggaatggggagcagggcgtgactgctgatggggatggggcttctttatggggtgagagaatgttctggaaatggtggtggctgcacaactctgtgaatacactaaaaatcactgaa

SEQ ID NO: 17658 - DNA, 675 bp, Homo sapiens
  ENST00000562580
aagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccac

SEQ ID NO: 17659 - DNA, 364 bp, Homo sapiens
  ENST00000562564
gacgagaacaaaccccaggagaagcggcccagggctgtgaccgcgtacagccccgaggacgaaaagaagggggagaagatctacctgtacacgcacctgaagcaacagcccatctgggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgca

SEQ ID NO: 17660 - DNA, 733 bp, Homo sapiens
  ENST00000562388
agtgagagttgctggtggctaattaggcagcagtgcgttttagtttctgctgacaattccaggcaggccatggtgggcgtcccagagacaagggcccagctccccggccctttcccctgggaggccagcgggtgacgctcttggggtttctcctgcagcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggt

SEQ ID NO: 17661 - DNA, 7404 bp, Homo sapiens
  ENST00000258180
tcgcgccgcggcgccgggaaaggacccggctgctcgcgggcggcgcagtcgccgcagcagccgagtctgacggcgccggttcgctgcccggtccgcccgcgatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaacttt

SEQ ID NO: 17662 - DNA, 7381 bp, Homo sapiens
  ENST00000538274
tcgcgccgcggcgccgggaaaggacccggctgctcgcgggcggcgcagtcgccgcagcagccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaacttt

SEQ ID NO: 17663 - DNA, 2303 bp, Homo sapiens
  ENST00000562663
gcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccact

SEQ ID NO: 17664 - DNA, 2366 bp, Homo sapiens
  ENST00000563726
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacagttgtttctggccaggtgttgtggcacatgcctatagtcccagctacttaggatgctgagatgggaggatctcttgactccgggaaatcaaagctgccgtgagctgtgagcatgcccctgcactccaggcgatagagctgggggaaggaggaatagttgtttcttcaaattgaaatccaaagatctactcaaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccac

SEQ ID NO: 17665 - DNA, 2149 bp, Homo sapiens
  ENST00000566153
tccaaagatctactcaaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggaggtctgacccctgacccttgacccctgaccccagctccacttgcccccagcacaatgggcctcccaatatccacccttgatcctacctgtactcctgacaccaccccacactcccttactacagtggggctcctgacatcccagcccctgaccttgacccttgacccttgaccctgggtgctgcaattcagacacactttgcccccagggggatctcattaactttgagaagaggaggaaggtgagtggaggctacagtgggtgtggtggtgcctgagggtgggggtggggcaggggtagggtcttagaggctcgtcctccaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaacagg

SEQ ID NO: 17666 - DNA, 2542 bp, Homo sapiens
  ENST00000380456
acccgccacccgccggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaacag

SEQ ID NO: 17667 - DNA, 747 bp, Homo sapiens
  ENST00000568628
ggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggttcccagtgacagcagaatgagcttggcttggcagtagctgcagagggacccatggctgttcaggttcgcggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttat

SEQ ID NO: 17668 - DNA, 2278 bp, Homo sapiens
  ENST00000393423
ggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagcctctgcatctcccccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccc

SEQ ID NO: 17669 - DNA, 440 bp, Homo sapiens
  ENST00000566919
cccaaaatgctgagattacaggcatgagccactgcgcccagccaatgttttcttgagattttaaatgtggggctattgaatgcaccagtggtggctggggtgttcgtgcttttctagccctcagcatctgcagatgggccaagctgtagcctccaccccttactgcctgcagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggg

SEQ ID NO: 17670 - DNA, 501 bp, Homo sapiens
  ENST00000589032
cttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctaca

SEQ ID NO: 17671 - DNA, 1455 bp, Homo sapiens
  ENST00000453604
actcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcagtgagtgattacagtttgggatggggacaagtgggaccttcagggagggttgtggatggtgatggggtcagtaatggccccaagtgactggagctttgggggctgcagaaaccacccccaggccctgtcccctaccttggcaccttccttacggacctggttatgctggacacagccctgccggatatgttggaggtctgacccctgacccttgacccctgaccccagctccacttgcccccagcacaatgggcctcccaatatccacccttgatcctacctgtactcctgacaccaccccacactcccttactacagtggggctcctgacatcccagcccctgaccttgacccttgacccttgaccctgggtgctgcaattcagacacactttgcccccagggggatctcattaactttga

SEQ ID NO: 17672 - DNA, 562 bp, Homo sapiens
  ENST00000565895
agggacagggactcacccaaggtcacacagccagtcttggattcaaacttgagagtttgtaaccctttctaatgatcaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttca

SEQ ID NO: 17673 - DNA, 973 bp, Homo sapiens
  ENST00000569439
ctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagccccctctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctga

SEQ ID NO: 17674 - DNA, 521 bp, Homo sapiens
  ENST00000561687
aaaaaaaaaaaaaaaaaaggtaccaggagtcatattctatgtcccccactctggacccagctctgagaccctgcctctctggccagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcagttgtttctggccaggtgttgtggcacatgcctatagtcccagctacttaggatgctgagatgggaggatctcttgactccgggaaatcaaagctgccgtgagctgtgagcatgcccctgcactccaggcgatagagctgggggaaggaggaatagttgtttcttcaaattgaaatccaaagatctactcaaggacctcccagagttgcccaaacttctgacccagactcttca

SEQ ID NO: 17675 - DNA, 557 bp, Homo sapiens
  ENST00000567431
aggaagggaggggctcggaggcgaccagatgaggcgaccaggtagaaaggggactgggggcggccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacag

SEQ ID NO: 17676 - DNA, 264 bp, Homo sapiens
  ENST00000563436
tagcgaaccataacctccgtattctccaccctagaaccccaactgggcacccccctccacctcctcagggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagag

SEQ ID NO: 17677 - DNA, 537 bp, Homo sapiens
  ENST00000567080
actcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggaccaccctcaggatttccgagaccaccctgcccattcggacctgggcagtgtccgaacctttctgggctgggcgg

SEQ ID NO: 17678 - DNA, 771 bp, Homo sapiens
  ENST00000568420
cgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagccccctctaggttcccccttcttcacctgctggggggcctcttcccagggtagagatcaagaagacagcggtacaagatctgagcttcaacaagaacctgaggtgggtccttcatccagataggggagtgcggggagggaaatccaagaggtcaaaggttagcagtcggactggggttttgaaaattgcaggttgggtaataagagactgggagtcaggtggggcgtggtggctcatgcctgtaatcccaaca

SEQ ID NO: 17679 - DNA, 504 bp, Homo sapiens
  ENST00000561570
ctcactcagcggcgccactgagagggacgggcgccggccatggagcgcacagcaggcaaagagctggccctggggcgtggggatgcagcaggaggactcggcccgagtccgagcggccaaggaggctgaggccccaggacctgtgcccctttggtgccctgagtccgcctgtgcgtccaggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccg

SEQ ID NO: 17680 - DNA, 11350 bp, Homo sapiens
  ENST00000329082
agttgtctcccgagcgctggctgcgccgcccgagccgctgggccggggaagcactggccgttcgctcccgggccggctccgccaggcgctcgcaggcatgcagcccgggagcaggaggcgctccccgggccgctgctgagccggccggggcggcggggaccagcgccagcggagcccctcccaccttgccccggggcagacgagcggcgccccgacaccccctcttctcccgcagccccgccagcgccaccccccgcgggccgcaggggctcatgcagccgccaagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttcttttagacgtgttggagtttgttttctgaacagactttggctcccttgaggcgggtggaggatggactttggtggtgggatcccctgcagcaagtgtgtgtgtgtgcgcgcatgtgtgtgtgcgcgcatgtgtgtatgcatgcctgtgtgtgtgcgtgcctgtgtgcgtgcatgtacgcatgtgtgcgcatgcctgtgtgtgcgcccatgcctatgtgtgtgcatgtaggcatgtgtgtgcgcatgtgtatgtgcgtgagaatggtgtgaaggcggatagaagatgcagcagtttaacagccaccacacattgcttttgtaaagtcacttttcctcctcacgatgagctgtctttggagcttggcaggcccagatcctcttgttctagtgacagtggaacacagtcagggagacaggtgactatgtggtggagagacatatggtgccctctgggatgagatgggtgggatagcctgagatctgggatgactccctctcagccactgctatcagcctggagccccagctgttgggactgcctgccaccctccctgccagtgcccatcttctcatagcccgggcggagcagtggtgctgcaggaggctgctgtccacgtcactgtgggaccaggtttattggcagctgtgatcacatttcatctgtacaaactacccagtgaatcaggaagaaattcaggcccattttgccgatgaaacagactctgagattaactgacttgcctagggctccttagcaacgggaaggacaacctgtgcacctaggttagtattgtcctgaagccccttctcttcaaactaaatgccatgaggcagaatagcagcacagttaagccagcctacatcctggcttctccacctccccagcagtgtgaccatgggcaagtcacttcacctctctgagcctgcatgctgttctctggaagatgggggggtgcctgtcccatacagttgtttggagagtcaggagttcattcctgtaaattgcttaggagagggcggggcacacatggcttgtctggtcgtggggagggagggggtggtattatcccaaagcaagataaatcagttaaggggagaaggaaaggggcgatacagaccctggactcttgggagaggtgaacctgcaggctagcaaggggaggagtcccaagagtggccaagttcattaatcccaggcagaccaggaaggctgaagaaaaaggagaactttattttatttttgaaatggagtctggcgtcttgctctgtcgccaggctggagtgcagtggcaccatcccagctcactgcagcccctgcctcccaggttcaagcaattctcctgcctcagcctcccaagtagctgggactacaggcacacaccaccacgcctggctaattttttgtattttagtagagatggtgtttcaccatgttgaccagtatggtcttgatctcctgacctcgtgatccgcctgccttggcctcccaaagtgttgggattacaggcgtgagccaccaccgtgcccggccaaaaaaggagaacgttctaaagccctgttcttgcagggctcccagagagaacacgggagttgggtttgggaggcaggaaccagactggaaaggacaaaacgtacccagcatcttccctggcggccggaaccgtcactacaggccccgtgcccttagcagtcccagggacagagcgactcagggaggcagcaaggaggagcggagccattggtgctcgtccggcacagagaacagttcctgagaagccagggcacacagaagaaaaagaaaaaagaaatctctactagacgaaaatgctaaatggcactagccacaaagtattcttggtttggaattttttttccaggaccctaaatgtaaccggctggaattctttcccaagtgccatgctacttactactggttgccctcacgagcatggaaatgccgtcgtgaatatggaacacagcatcctgagctaaaagattcccaagaagcagcttcatcttgcaggacgggctaggttgggagcctctggaggttcctggctgccagctccgcggaggcctgcggcctggaggtaaatgcattagcacacggaggtgggcgcctctccccgccccatcctgtctcactgatgtgttgccgagaactggagttcttgtttagctaaccagaatgtgcaaggctataggacaggagagaaatggcctttaaaacaaatgaatgagagtcacgatgaagggggcagacgggggggtgaaaatcattaccagaacacttgggcagagacccgtcagagccaggcaggagacagtcatcagagctgtgccagcaagtggcatggagcaggggtggcacttgggctcgggctgcaggcaaacttggcgtcaaaactggctcaacccgtcgcgagctgtgtggtctccttgggattttttgagccttagattccttatttgtaaaatggatttgtgagtctccacctcccgaggtcagtatggaaatccagtgagctaacactcgtcaatggcctcgcacatggccctggcaccacgcatggaggccgccaaaagtggccgcctcctctctgcaattgcatttatttatccatttgataactctattgggtgtctacccagcattgttcaggggggtgtgaggggctaccgcaatgacccagacagactgctgtgcattcttattggaaagacaaggcaataaaccacagttacaaaacccagggtcccatggtaacgagctccacagagaaaagggaagtgggccagaggttccgagagacacacattttggattgcaggagggtgagaaggggcattcatctgtggtggggttaaggggaggcctccgactagctcacctgcatgaatttcaggaacaagccatgcagagccggacagagcattctgtgcagagaaaacagtgtaacagccctagagcagcagcagcaaagggggagtttaagggatggtgggaagccactgtcactggacagtagcaagtggacagaccaggggtcccaggtgaggccacagagcagccaaagtactgcagggctctccggctccgggaggacttgatgtttgactccagttgccagaggaagccgttcacgggctttgagtgtaggaatgatgtgtccgacttgggtctttttattgttcttttttagagacagggtctcactctgtcacccaggctggagtgcagcggcacaatcacagctcactgcagcctccacttcctgggctcaagcaatcctcccacttcagccactcaagtagctgggattacaggtgcctgccgtcacacccggctaattgttaaatttttttggagagacaggatcttgctgttttcccaggctgatcttgaactcctgggctcaagcgagacgtctgtttcagcctcccaaagtgctgggataacaggtgtgagccactgggcctgccttggcttgggtattaaaggaattgttctagttactatatggaggtgacttggggccgctggggaagaaagaggaagtcaggagccagtctgaggcagtggcaatgcagcgattatcagaaataatgggctcaatgatagactggataaagaaaatgtggcacatatacgccatggagtactatgcagccataaaaagggatgagttcatgtcctttgcagggacatggatgaagctggaaaccatcattctcagcaaactaacacaagaacagaaaaccaaacaccgcatgttctcactcgtaagtgggagttgaacaatgagaacacatggacacagggaagggaacatcacacactggggcctgtcagtgggtggggggctgggggagggagagcatcaggagaaatacccaatgtagatgatgacgggttcataggtgcagcaaaccaccatggcacgtgtatacctatgtaacaaacttgtgcgttctgcacgtgtaccccataactgaaagtataatcataattttaagaaaagaaatgatggcctttggggtctaataagaaggtggggctgacagggcttggggagagagcgagcttgacaggagaccacgatgtcttccccaggggtctgagcacctggggaaatggtggtgccatttaccatgactggaaagatcatgggaggagcaggtttgggacactgaaggcccgagagcccctggcaaaccaccagtgtaagtccaagagtccaaaagctgaagaacttggagtccaatgtttgagggtaaaaaacagccagcatgagaaaaagatgaaggccagaagactcgtccagtctagcccttccacattcctctgcccgcttttatcctagcctcgctggcaggtgattagatggtgcccacccaggttaagcgtgggtctctgtctcccagttcactgactcaaatgttaatttcctttggcgacagcctcacagacacacccaggaacgatactttgcatcctccaatccaatcaagttggcactcaatattaaacagtttcggccgggagcggtggctcacgcctgtaatcccagcactttgggaggccaaagcgggcagatcactaagtcaggagatcgagaccatcctggctaacacggtgaaaccccatctctactaaaaatacaaaaaattagccaggcgtggtggtgggcgcctgtagtcccagctactcgggaggctgaggcaagagagtggcgtgaacccgggaggcagaacttgcagcaagcagagatcgcaccactgcactccagcctccagcctgggcgacagagcaagacaccgtctcaaaaaaaaaaaaaaaacaactaacagtttcgttcattaaggcaatgtccatggggcagctcctgcatgccacgccacccctgccctgacatactcccaggctgaccagccagaactggggagagggcatcttgaagaaacagtccaccctccgccctcgcatacctgtgtctcccagcagacaagacacacaagggcagggactgcactttcctgtgtgcaaatctcaggtatggtccagaaatcacatctctttggtctgattggccttacttaccaaacccttgaaacaatggaaagaagcttgctgcaatgggaagacccctgccccccaaaccctctaaccaggagtctacagacctcattccgtggaagttcccattgtcccctgggaaaccaccaccttctgaatcggcacagccaaggcccccaaccctgctatcaacagctttccttagccaccttccccatcctgcagggcttttcaacatttcgactttttaatccttccctccctaagatatagacatggtgttagtagcagaaccctgaaggcaaaggaacagaaactaacactctcagaaagtcctagcaggatggtctgaattaatagacagctgcaggcagccagtgtgcaaggcacgctcgtaatgtcagtggcgttccggaatgagggctgtgatcccaggcagcccagatcccaaggcgaaaacattcatgtcgcccagcatcaccctgtccttgcccagggtgaccctgagacggcacttggattcttccacatctgaactcaaacctgctccctcagctctccccagcaggaattggagccctctccaggccgttcagccaaagcagaatgtgtctggccaagcagatctgcccagagaagaacaaagacgtgttcagacactgtctggggaattggttttgagctcactctgagctccatctgtgcaacaaggccagcgtcagctgttacagagaaggggcttgtggcagtttattaccctggtgagctggctcggggccatgctgaccgcaggactgtaaaggacataaggcagttggcaatatgggaagcagcagtccccaaagcaccccgtcaaggaaacgatgcaagagctctgtccactggaccagccccaccctaccccgccacgccctggcctagggggagggaccttgtgtttcacgggcctggatggccagggatggacagtggcatgggcacagacacacccagaccgaaggaagggcccgggctccagaaccagacccgatccaggctcccagctctgtcacctactggctgcatgaaaagggtgggttttccttgttttgcagcctcagctatctcagctgtgagggaacaatgacgccacctccctcacgtggcggtcctgaagatgaaatgtaatgcatgcagcgcggcggccggcccaccgtgtgctcttagtaactggccgctgttctcttcagccctcccgttactgaccacctcgagggcaccgttcctccaagctgaccatttcctgccagtcacccactgcccagctcgcccagccatggagtgggctctggtccacgtgcatggtgagctgccatctttgtcgtcctctggacaccacgtctacctccttgggaaatagaaacgagtcctgcattgctttgtcaaatttcacaaaaaccctagaaagcagatattgccctggtttacagacggacagacagaagcaaagagaagccaactgacccactccaggttacaagcagggtctggtaggagagcacgcgtccaccccaccgctcactgcgcccacctactcctcgcttgagggcagagaacgagctggggcggggcgctccagggggcacaggcagcctgtgttcaaggcatgctcgtgagccccacagcaggggcggagtcaaaccagggctctggttctggggtgagcagagggtggggccaggcccccactgggaggctgactgaggaggggctcaaagggcaggcaggctccatcagagcggtttgatgagcagggccgctgagtggccctcaggtcaaggctggggccgggaccaccagggaccaggtctgcggggccaggggtccctccccagggtggagcaggaaaactccggcaaccgccttcttgagtggacttgaccttccctttctctgctaatgatctcagattaatcccttaaggcaagtgccccagggtgggtgttggttgcataaaacaagaggagtccttcttcccttccttcctggcacaaacatttgtaggccacccccgatgtggctggtcgtagtctggatttgggggcacattcaggcattcaacaaatacgtcatgaggccccgtgatgagctggggggctatgcttgatgtcggcagtacagctgtggtcgctcgaatgaatgtgcccgccctcacgggactgacctctagtggtgagagacagacactaaccgagtcacatgtgtgattacacgtgtaatcatacttacatatgtaacaacacgagttacacgtgcagtgtggggagggggcccttcacggtgaccagcccatcagggaaggggatgcgggtggcagaaggaagcggcacacccttgtcctcacggagctcacaggaggttctctgaccctcatcttaagccacaggctgtgtctgagcctcactgccctagctatcaactgggtgcaggactaggccttaatcactgggcagcgggaagaactacataagctcatactggcgcaaagccccttgggagaccgcagggaaagccattgcatgaggtggtgacaggctcggccttcagagtcgggctagaatctgagttctgacaatgatccccgccttgacccatctctcctcaggccgccctgagccttccagttaggcctgggctttgggcttccgtgtttgtctctggattgttcggttttagcaagagtcctgctaaattggtcttgctggaatcctccgccctccacatctgattgcccttcctgtctgatcgtggtcttcatgccccacggcctccaggggacgtctgatcacctggcctgccttcagcaagaatccccccaggtgtttcctcttaagaggttttccatccactgagcccaccctgctccttggccatcaattcccacttgcctgtactgtattcagaggggaccccaatctctcttcccagctgcagcggtccctgtccaacactgccccccacctcaaataaagtctttcttactgtctttaacatatgccgtcaataaagttttagcagatcc

SEQ ID NO: 17681 - DNA, 3038 bp, Homo sapiens
  ENST00000542321
cgcccgcggccgaggtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtta

SEQ ID NO: 17682 - DNA, 3172 bp, Homo sapiens
  ENST00000554387
agacctagacaactcggaagtgggtttttcagcctcctgcaccggtgtcgcgtctgagtgcgactgatgagccagggggcgtcggtggaagcttgggggagaggctagtggtaacaggccgagctggatggatgggtatggggagaggggcaggacgttcagccctgggattctggccgaccctcgccttccttctctgcagcttccccgcagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtt

SEQ ID NO: 17683 - DNA, 1929 bp, Homo sapiens
  ENST00000557301
gtttcatccaaaagatgtctctcaggggaagttaccagtcccttaaatatcacaacggcagcagaactgcagggcccagggaaccttgggaaggagatgtttctttcccagaaaaataagcgacagagttaggaaaggtcaccatactgaagccctcccaagtgcagccttgcgggcctcgcagagagcgccaaaccatccggccctgcgcgccacgcggaccggcatagccatctctctggagtggcagctgtgccaaggtggcaaggttaggcccgcaggccctcagcacgggggcgcagccggggcaagtcttcaggaagcagcgaggtgcttgaagggggtgctggaggcaggccaaacccagtcaggatgggtggcctggggccacgacgggcgggaacctcgagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaagg

SEQ ID NO: 17684 - DNA, 989 bp, Homo sapiens
  ENST00000557420
ccgcggccgaggtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatg

SEQ ID NO: 17685 - DNA, 1889 bp, Homo sapiens
  ENST00000556658
aagtgggtttttcagcctcctgcaccggtgtcgcgtctgagtgcgactgatgagccagggggcgtcggtggaagcttgggggagaggctagtggtaacaggccgagctggatggatgggtatggggagaggggcaggacgttcagccctgggattctggccgaccctcgccttccttctctgcagcttccccgcagacagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacgtaagtttcgccgattcatcccccggcctccctcagttgccccaccacccatggtggcagagatcccttcagcggggacagaacctggcagagaaggggaacgggccaaagactccgcgcagcggcccagacgacggcgccccccacccttcttctaccgacggtggtttgtgcgagtccctcggccccccagccagcaacagcctacagagagcactgacggggtagagcccaaagagccccattggaggggcagcaacagcagggagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggc

SEQ ID NO: 17686 - DNA, 552 bp, Homo sapiens
  ENST00000555584
agtgttctgatcacgccctgggtgctcactgaaaatgcttcaggggctccctgccatctattggaaaaaagcagaaatccttaggctggtgtgccagggtccaatcagaaaagcaaaacccacccgggatgtttccgcagaggggacttcgtgtagggcattgttatgggcatgggaagactgaaagggcaaagagggaccgctgggacacagagtggcagaagcagcttccacccctgcagccagagggacagaaggaaggcaggtttggaggagggcccgggactctgatggggaagaagggccgctgctgctgccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcg

SEQ ID NO: 17687 - DNA, 547 bp, Homo sapiens
  ENST00000555598
ctcccgctcgacgcccggctgcggagctgcctggccatctcctgccctcggggatgtcggcgcagtgcaccgcgtgggctcgcgtcccggcggccctttgcctcggcgcgccggcgtacgggaaggtgcggaccttggattgagggccgaggatgcccattgccaagccgccccggctttcctaagtggacgggagggcacggcgacgattcagcgccggctcgcgccgcagctcaacccaggggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcata

SEQ ID NO: 17688 - DNA, 473 bp, Homo sapiens
  ENST00000557608
gtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagacagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacgtaagtttcgccgattcatcccccggcctccctcagttgccccaccacccatggtggcagagatcccttcagcggggacagaacctggcagagaa

SEQ ID NO: 17689 - DNA, 320 bp, Homo sapiens
  ENST00000556950
acacgtcccttacaccgtgtgcgggctgggagctccttccctcagcccggctcgcggagccccggacggagccggccacccgactgtcccgccgtgaacccccattggcccgcgccgcccgggcccccgcctcccgctcgacgcccggctgcggagctgcctggccatctcctgccctcggggatgtcggcgcagtgcaccgcgtgggctcgcgtcccggcggccctttgcctcggcgcgccggcgtacgggaagggagaggctagtggtaacaggccgagctggatggatgggtatggggagaggggcaggacgttcag

SEQ ID NO: 17690 - DNA, 3078 bp, Homo sapiens
  ENST00000425933
gtagctgagatgcagagagccatcctgcccagacctagacaactcggaagtgggtttttcagcctcctgcaccggtgtcgcgtctgagtgcgactgatgagccagggggcgtcggtggaagcttggggtcggcagtctggttggaaaggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 17691 - DNA, 3174 bp, Homo sapiens
  ENST00000543599
ctcccgctcgacgcccggctgcggagctgcctggccatctcctgccctcggggatgtcggcgcagtgcaccgcgtgggctcgcgtcccggcggccctttgcctcggcgcgccggcgtacgggaaggtgcggaccttggattgagggccgaggatgcccattgccaagccgccccggctttcctaagtggacgggagggcacggcgacgattcagcgccggctcgcgccgcagctcaacccaggggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 17692 - DNA, 880 bp, Homo sapiens
  ENST00000504776
gccttaggtgtctctttaaaccctctctcccctctttatttccaaatctttatctttggctttcttaagctgtaaaggcacactggcaccttaggtggtcaggtaagatcgctggattccttatttcggcgaaagtccagcggaccattcccgccactgtacccattttagaaacacttggaagacccttaaggatcatttacggagagaaaggtcctgcgtgttccgaagttcaggggccccctgatcccgctgagccccctccaggagcgaaagggttaagaatgatgaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccag

SEQ ID NO: 17693 - DNA, 446 bp, Homo sapiens
  ENST00000505265
tatttgaggctgactggggagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtgggaaggctgcactggtttcctgagataaatggacaggaagcgcattacctccgcgcgctggcaagcggctcccaaatgctttttgcacctgccgttttgagcggtgagagcagc

SEQ ID NO: 17694 - DNA, 2513 bp, Homo sapiens
  ENST00000434027
tatttgaggctgactggggagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtgggaaggctgcactggtttcctgagataaatggacaggaagcgcattacctccgcgcgctggcaagcggctcccaaatgctttttgcacctgccgttttgagcggtgagagcagcggcggagcccgcagggattgcgggggcccgttgtctacgagcgggtgatgagccccccgcaagccccgggctctctccctccgcgagtgcattgctcacgccaagctttgggactcttctctcacacccaggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataaggcaagtataccttcttttttccctctccctactcaactttcaaaagatgtttgattcttcagataacttttgaaatgtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaatccatgttcagatttatcagatgattgaagtgggtgttctgaataaagaaagctgtgaggcctgaggcagtgacgtatcaggaaacatattttattggagatttggaagctatagtaaaacataatggcaataagccaacttcccagtggtaaacccacagtggtggtttagttactaacctcttgatgaccgaggaggttaataattggatattgcagagcagcaatatgtaacctgtgtgtaatctcagggcctcaggttaacagtttcagtcagaagctaagagaaacactgacaaaatttagcttaccatgactagctgccagtttatgtggtctgtgttcgtttgttttaaagaaactaatactgtacagagatctttgacaccaacttcaaggcaccagtgtttagtgcaagcaggtagagaggacctatgaactaggtttctaattggcagtcagtgctaattcagccattagtaagtaaagtcacttttccactaaaatagtgtcccgactaaccacctccttccgtgtcttttccaaccacaaaaccacacacatagaccatctcatcttactttatttcttgcatttattgtatccaaaaaaattggtttagttttttaatgtaattgacaagactcaagcttttgaaatacttacgactgttctcttgattccaggacaccctcccctgtgtctaaacatgtgtggtatactttttaaataaattaaagcttattttacttggc

SEQ ID NO: 17695 - DNA, 4580 bp, Homo sapiens
  ENST00000308234
atttgaggctgactggggagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 17696 - DNA, 300 bp, Homo sapiens
  ENST00000507054
attctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtcctgcgtgttccgaagttcaggggccccctgatcccgctgagccccctccaggagcgaaagggttaagaatgatgaagggaaatgtcaaactagaacacctgagcctc

SEQ ID NO: 17697 - DNA, 2052 bp, Homo sapiens
  ENST00000513185
gagattgatcgaccgcgggggctgccgcgcagagatatccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaagaaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtg

SEQ ID NO: 17698 - DNA, 427 bp, Homo sapiens
  ENST00000508978
gacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataaggttatgtcatggctccctgacggtgaaatatgtgtgaaatccaaccaacacccagcaggatacactaacaaacattctacaaagccagaatggatgccctcaccctccttggaatgatgttaaaccaattgagtaaactggtcctgccaactgcaatgtaataaagtaggcctatcaaacttc

SEQ ID NO: 17699 - DNA, 2427 bp, Homo sapiens
  ENST00000367558
gcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccacgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 17700 - DNA, 877 bp, Homo sapiens
  ENST00000483295
gcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatg

SEQ ID NO: 17701 - DNA, 1354 bp, Homo sapiens
  ENST00000235382
aaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacacttgga

SEQ ID NO: 17702 - DNA, 665 bp, Homo sapiens
  ENST00000464302
aacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggg

SEQ ID NO: 17703 - DNA, 333 bp, Homo sapiens
  ENST00000487236
caagagcgaggagaagcgagaaaagatgaaacggaccctaatcctgcggctgaagcgcgtccccagcattcatacgttgcatgatgagttctcatcagcttacacagctactggaagtttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaa

SEQ ID NO: 17704 - DNA, 2104 bp, Homo sapiens
  ENST00000297313
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 17705 - DNA, 1518 bp, Homo sapiens
  ENST00000517659
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 17706 - DNA, 1667 bp, Homo sapiens
  ENST00000344277
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 17707 - DNA, 1434 bp, Homo sapiens
  ENST00000523280
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 17708 - DNA, 455 bp, Homo sapiens
  ENST00000518286
gaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactcca

SEQ ID NO: 17709 - DNA, 668 bp, Homo sapiens
  ENST00000523414
ggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcagggcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaa

SEQ ID NO: 17710 - DNA, 1559 bp, Homo sapiens
  ENST00000522225
agagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctctctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaatttt

SEQ ID NO: 17711 - DNA, 1664 bp, Homo sapiens
  ENST00000276500
gggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaa

SEQ ID NO: 17712 - DNA, 610 bp, Homo sapiens
  ENST00000523064
gagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatccagatgttaaagtttattcttacatagaaattgaggtttctaataaaaggtgtgtggacgtgg

SEQ ID NO: 17713 - DNA, 793 bp, Homo sapiens
  ENST00000517405
aacattacgccaagtgaaaggagacagccagcaaagatcacatacgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtattt

SEQ ID NO: 17714 - DNA, 3311 bp, Homo sapiens
  ENST00000421743
agtttctgtatgctgccgggcttataactgtctgtcatccagctatttctctccaccttcttgtttgcataacaaccaaggcaacttccgcaaatcactgcgtggagacgatgatcctgccagctcccttttggaaatcgtgaggatcagatcttggaccatgtataatatgatgcttctaatccaaaagaggaaaggcattgggagtcagctcctaagggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 17715 - DNA, 563 bp, Homo sapiens
  ENST00000527393
atgtataatatgatgcttctaatccaaaagaggaaaggcattgggagtcagctcctaagtaagctccagaattcctgctggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaat

SEQ ID NO: 17716 - DNA, 3200 bp, Homo sapiens
  ENST00000367909
gacattgagtacattttttcccatatccctacttttcagaaggattttctctgctcgttcacttaacattgctgatgcgtcagtcttttcttcctcatctctttcaggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 17717 - DNA, 544 bp, Homo sapiens
  ENST00000531057
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaatattgatctgtattaagctccagtgctttatccacattgtagcctaatattcatgctgcctgccatgtgtgagtcacttctacg

SEQ ID NO: 17718 - DNA, 817 bp, Homo sapiens
  ENST00000527809
aagacgctcagaggattctgacaatatctttaccggagaagaggcaaatgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtggg

SEQ ID NO: 17719 - DNA, 2606 bp, Homo sapiens
  ENST00000367908
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaat

SEQ ID NO: 17720 - DNA, 3774 bp, Homo sapiens
  ENST00000491263
gacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagaggtaagagaaaaggccttggtgaagatgtacttagtattaactatctgatgatggggatgttctgtgagaaggaacttgtgctcctagttaagccagatttggatcaagatagcctccattttcatggagatcataactacatttgaaatttctatacatttagtgaaaaactgccctcatcaataacatattttgtcataacgatggaaaataaaatctttgccttcattcaggatcttagatttcttgccccaatttttttaccatggcattccaattattctgtttctctctattttttctagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtaggttttttatggatacataaaaattgtacgtatttatggagtatgtgtgatattttgatacatgcatacaatgtgataacaatcaaatcagggcaattgctatatacatatctcaaacatttattatttctacgtgttgagaacattccaaatctcctcttctagctatcttaaaatatacaataaactattgataactatatcaccctaatgtgctatcaaacactagaacctattccctctacccaactttctatctattccttctacccattagccaacctgaccaaaaaggtaagcttttatggcagagaactctctggatcttagtgaaggttcctagaatagtggagctgactatcataatcttgacaaccccaaataaatcagttttttaaaaaatctcttttatccatgtggcttaccataacctccctgcatgaatttttctgatgaatctccccaatttgttagacagaacagaagatcttgccctgctctctctaaagcagaaaggttcattctgaacctttcatactctctcacatgtgccaaggaggaccccaatgtcacttttgttttttgcttctgaaatacagagggtgcactgccacttacaagtcactacaaagcatacaggcttgcatcctcaacagggatataggtctaatgaagccttggcctttgcccctcaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaat

SEQ ID NO: 17721 - DNA, 540 bp, Homo sapiens
  ENST00000533019
atcgatggcttctttaaaatgaagcaggagggtctggcagagagtatctatgaaataagttcctctgaccttcacgcttaattttctgaatggagtggagcaaattacttcaagcttcacttaacttgcatatgaaatgaaccgtacaaaaatacaagagtgtcaggagaaagttatgctctgtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccag

SEQ ID NO: 17722 - DNA, 930 bp, Homo sapiens
  ENST00000367906
agatcactcatgtgttcagtgattcaggttctgttgaagataccaaagatattcggttggtcaaaatgacgggcatataaaggcttctcaggtttctgagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaa

SEQ ID NO: 17723 - DNA, 551 bp, Homo sapiens
  ENST00000528938
aaactgaagggtcagaattccagttgtggatgaaggaaatggtgttatgactgcctcaaggttttgtagcaagtcatagggaaccaagaggaatcttgttttcctcagagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaa

SEQ ID NO: 17724 - DNA, 2005 bp, Homo sapiens
  ENST00000553525
gcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttccta

SEQ ID NO: 17725 - DNA, 1764 bp, Homo sapiens
  ENST00000555571
agccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 17726 - DNA, 5685 bp, Homo sapiens
  ENST00000553530
gactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaa

SEQ ID NO: 17727 - DNA, 2111 bp, Homo sapiens
  ENST00000554474
gttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagaaagtgagcaaggtcgtagaacttccctagaaaagttcactcgcagtgtgtgctgctggcgcagagtcagaatggccgctgcatttcacccccgaggtggcttccttccagcagtggggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaa

SEQ ID NO: 17728 - DNA, 1689 bp, Homo sapiens
  ENST00000556437
caccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgaggg

SEQ ID NO: 17729 - DNA, 1564 bp, Homo sapiens
  ENST00000355512
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaagg

SEQ ID NO: 17730 - DNA, 1497 bp, Homo sapiens
  ENST00000404301
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgtgtctgcagcttctcttctagggatgaaaatgcaaaaaagagcaagcggctccctctgcagaaggtgcacccttg

SEQ ID NO: 17731 - DNA, 1476 bp, Homo sapiens
  ENST00000406236
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatgaaaatgcaaaaaagagcaagcggctccctctgcagaaggtgcacccttg

SEQ ID NO: 17732 - DNA, 1497 bp, Homo sapiens
  ENST00000407322
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgcttctcttctagggatgaaaatgcaaaaaagagcaagcggctccctctgcagaaggtgcacccttgatcgcccag

SEQ ID NO: 17733 - DNA, 986 bp, Homo sapiens
  ENST00000553690
aaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggagcttctaaaatcacctctgctttgaccttgaggggccgtggtagaggggagacagcaccggcttagaaaccccacggctcggctctagtcccagcatcagtggagcaccaaggggagaaagtattcatcactgaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatca

SEQ ID NO: 17734 - DNA, 896 bp, Homo sapiens
  ENST00000555368
cgttgcaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcactccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaaggt

SEQ ID NO: 17735 - DNA, 1828 bp, Homo sapiens
  ENST00000434263
cgttgcaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaat

SEQ ID NO: 17736 - DNA, 1110 bp, Homo sapiens
  ENST00000554782
aaaacactgactatgaaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctgatccc

SEQ ID NO: 17737 - DNA, 688 bp, Homo sapiens
  ENST00000554734
ctaaattagccctaaatagaagggtctgaaacaaaaaggcaggacgtcaccttgttcaatttcagtgggaaacacacatatcaggctactcaagccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgcca

SEQ ID NO: 17738 - DNA, 548 bp, Homo sapiens
  ENST00000553519
aaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagca

SEQ ID NO: 17739 - DNA, 454 bp, Homo sapiens
  ENST00000554300
agaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctg

SEQ ID NO: 17740 - DNA, 5400 bp, Homo sapiens
  ENST00000402788
cagattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 17741 - DNA, 5453 bp, Homo sapiens
  ENST00000622468
agattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 17742 - DNA, 5342 bp, Homo sapiens
  ENST00000343854
agattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 17743 - DNA, 664 bp, Homo sapiens
  ENST00000508162
atggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcccggaagatggtgagatccatccagaaatctgtcggctttacatccagctgcagtgctgcttagaaatgtataccacagagatgctaaaatccatatgtctgctggggtctcttcagtttcatcgaaaag

SEQ ID NO: 17744 - DNA, 4160 bp, Homo sapiens
  ENST00000334025
agccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagatgacagcagccttctgaatctaactccctaccccctggtgagaagacggaagagaaggttctttgggctgtgttgtctcatctcaagctaggtggctcctcctggaaacccactgagaacatctgaaaaaaaatcacaaaacccgaggacctccagacagctgaaccacacagttattggtttttgactatgttttctatgcttccttattacttttatctgcctccccctgcccttttaaatgattttacacttgaaagcagctgccgtcaagaaaaaaaagaacagattcaaaaaccaggctgtttttaaaagggaattttaaagctgacattgtgcatgtctgctccaaaccacgccatgacagatgcaagaattatgatttttaaattatttaaaggttttttaaatgtattatacagaggaaaaatatttcacatataatagtatatctatagctcttgctgatctcatgttaaaatttatcgtatatgaaagaagtctttaaacatagaaatctatttaaaactgaaaaactgtgttcaaaaatccaatctatcaatatcattagaaataatattataagcaaacatataccacctcacctattgctttctctgcactcatttacatttagtcttccattctgtcagaatctaagagcttcaacataaaagtatcttaatttataaagcaacaaaaaccacatatgaaaagtactaaaattttgtaaatacacaataatcctaataccttcgtacaaatgcatatgggcaactaatttctttttgatccaatgatgtctttttcagcttcttggagaatgaagtaatccagttaggaaatggtgtagtaacatatacaattgccctcaaatgtaaaatcaaatattattacattttgttctaattgaaatctgaagcatggtgtctgcacatcagcatagtgttaaatcttatagggcatgctggaattagctcagattataaaaatatttaacattttacattgttaataaagttttttagttaagctaagcttgtctcattttagatgactatgcagataagatttttccaacgtgtacttggtgtcttgtcttatgcttagactcttgaaagcaggacacattaagcaatactatattttagaaaggaggaagccacatgctttgtttttctgctcacagctttgttgtgatcttccttcactaaacttgtaacatggtacaaattttgttataccgtctcctgttcttcctttggcccatttcccagacagaatttcccatgggttgagagatcaagtctttgcactttttttcttgttttccatagtctgaaaaaccttcaagtcagacaggaggcaccagtgtccagtacaatagaaggatgagctagatgccgataagtggtttatccaagacacatctttagtcccaaccctgttctttaccaatacttatgtgcacaggcatttatatgtataccaatatttttacctaaaaactaaatatattaaggccttttgctttagtgaagatgaactactgtaataattattgtattaggttgaattatatgaaatttcctatatgtgactgttttgacctacaaaatggcaatttcttatagttcaccctaatatccaatgtggaaattatacttggaattgtcttctagctcttttgattgaaagtgaaagaattaaagggttggaagagaacgttatacaggtctctatttagatcataccagctggtttttggccttattctttgaatctagagttgtgttccaaggaaccagtaattaatgcatggttataggtatacctggcttcaaaaaaaagaagtagccgtggaaagctatatgagaaaatcacaattttctgaatcaaatatttgtaaaacaatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatgcaaaagttattaactgataagcccaatcttgttcagcacgttcttctaaatgcctgacctaaataacttctgcttggttaacttgtgttcattctcaccttagcctcagtgtgaaagtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaagatctaaagatcctctttcagtagcatatactaaaattaagtttagtgctcaaaaccctggtaacctacactggcccaaggttacagtaggtaattcaccgtctcacattagacaggccaatgcatcccttaggagctgccccactctcctctcacctaccaaaggattttctcaggtgtggttccaagcgataaagttctactgtctcggcttcctgctggtaattcgctttcagattagcaataacactgagctgatctctagggttaagaagagaacattgaactcattttgtcgcatgtacccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattccaccacgaccacattgtttaaaaccacatttctgggttttaaatcagtcagtggctgggcccaaaggcacttttgggtaagataagtgaagaaatgcccacaaggccaaggtgtcacttaaaaaaacaaacaaaaaaaa

SEQ ID NO: 17745 - DNA, 559 bp, Homo sapiens
  ENST00000505263
attgagcatttttccctctcggagctgagacaaatggctgatgagtgaaatcttgagaatgttcacagcttttctctttcattctgttgcagcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagtcaaaactcggctccacaatggtttactttaaatcaactttcagtggagaagaaaggaaggtggccaagggcaggaattttaatgatgacagcagccttctgaatctaactccctac

SEQ ID NO: 17746 - DNA, 5606 bp, Homo sapiens
  ENST00000258302
gttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcataggtgttcaaaagcggtggcattgggggtgggaggctgggggtgaggagggaatgaagggccattccaaagtatgacccagctgccggagcttggactctattccatttacccatgtttgtgttttggttagtggtagcgccttgccgctgtcacccttttctgggtcagcaacttgcccttcatataatgccttgggtcacctctgctgagagggcagatttgctgtgctaggctaatctgtaaataatgcaaatgcaattcccaccacctccacaccctcctcggttaggattcctgactctccacttgttgtaaatccctgggaggaatagctgaaagacttgggctcaactctgtgatttgtagtggccagctctgctcactgggatctcacagcttaggagagaggtttctgtggaattccaggtttctagttctgtcattgacaggtgacctctcagagaaggagtgaaatccatggagttgtttgtttcttccatttccattggaccagtgtgaaaaactgtgattacttcccatcttggcctaggaaattcacaagactaccctaaccttacatttccagaaagagtcttgggtgatgttcttcatgacttctgaagtggaactgccattaagaaagatacagcttgcaaatcttcctcaattctacgaagaacttttccagaagtcaagagacgagggcaagtagcaccagtagacttctattcaaaggggtaccatgtaacctgtctgttgctcagtgtcttctctgccctcacctctctgcagcatcatacatcactgatgtcttaggatgacagcttggcaaagggaggtgaattcctatagcatggagtgctcccatggtgcctaatactttccctgtatctccacctccccccttccatgccggtcatgtaattatgatgggggagaatgggaatttaggctgaaactctttccagcatacttcctgggaaaatgctttcttagaaagatctctctcttggatactatgaagcaccttctttcttgatctttgaccttttggaattgagcatgaaataggaggtgtggctaagaagatcactgtgaacatctggacgtggacaaccttcctaaaatgctttcatggtaccctgcagctgctcttggaaatgtgtcaggcaattcttccttggaggatgagtgagcagcctggaacctactctagccacccaggaaaaagctgactttggcacaagactagtgcccaggagatgaacctttagcagagagaccggaaagtgaaagaggggcatgtaagaggctggtttccaggtggagaggataacagagtggagttactattggaataattcacgaccagtggatttggattcattgcagatctacaaaacgttcagcttgactaagtggaacagcacatgattaggcataagctctggagtgcagatgattgagaactgggctgaaccattttccttttaaggggtgaggggccttttaacgttatgctggtggcgttctagtgcttgtgttcctctccagtaactttgagaatctcttccttttttagctatagctagaccaggccaagaaagcccttgagtcccactagtgctagggccactgcactgctacagcacattgttatctgtgagtgagggtgggtgtgactgtgtgaacctcaaggggagagaagaacacatgtctcctagccctcacagacaccgaaaagacctgtggaattttgtgtttgagaactccaaagcctcaaatgggtgttcctagttagatcaggtagtatcctcccaaccgtggttaaaaaaacaaatcattctttcttagataaagctgccagaattaatttaatgattaaattctctaacagggtattttaaacattgtttacatatgaaatgtgcatctgctgccaactctactgtcgaatatgaggtgcatataaattagaactgcacagagttatagaaatgtgaaacattctgaaaggggatttttctccacttccactattccaaggagaaaagcctgaacaagagtgtcgtgcgatggcctcatagagaggcctagagttcttgccaactattgaggaaacgaaggctgcagatggtggtgtcatggcgccctggtgacttcctcccacaatggggaggtgtgaaagaccaagcttggggatcctgaattttgcagctaagcaagggtatgtgggcatgtgtccatgtgtagaggaacgtgatagctaaatttatggtactcctgtggagtgtctctgtgtgtttgtgtgtgtgtgacaactgtgagcattagactagtacacggcagacatgatcttcccgtggggtggagctttcctcataccttgtatgccctgcttcccacaagaggcacagagctctccactctgatgcctactttcaggcactctggtcgtgccaacccagattttggtctgtgatgaaacaaagagaaatgtttacaacatctagagcaatatccaagcatacctcatccctgagcttccatgtttcccagtcctgccctctctcccattgcctcttccgcaagcccatgtccttgggtatcacttccatttatttcctgtcttccttggctcctcaagccgagcctgtgctgtggacttgccttctggacttgaggcttgctcagtcctgggcctatgcaggctccaggcaagccagggcagggcaagtccaggcaagtctaggcagagctgtgacttctagaattgctctccatccctgagtgatcttgccccactggagggctaacttgtttgggggctggtgtgagattcgtcattgcccttggcaaactaaatagaatactgtcagtatcaaccattcatggccttgggcacctctggggtgaggaagaatcctctgaggcagtccttctcattaaacttgagcatgcacaggaatcacctggaaagcctgtgacacgtgctaattcccaggtgcacacccagagatgctgatctgatagacctgagatggggcccagaaatccacatttttaataagttcctagatggctagtggcctgtggacttggactcttagacagagtctcacgaccttggctgctccttagaatcacctagggagtttttaaaacccagatgtccaggtcccaccccagaacagccaaatcagaagcttttgttagagacccaggcatcagtcatttttaaagctccacaggtgattccaatgtgcagctgaacttaggaagcattgagtctaaggagtgaggaggaacacagcgcgggggcgggggggctgggggaggggggagacacagctgtgtgggccaagggggctggtgtatctccacatgcaagcacgtagataccgaggaacctggccagccctgcagcctgactcgggatggctgcctctatgccctctgcgtctgactttctcctttgagataaaggtgttttggcccaagctgagtgcattgctgggcagcggccatgccgaaggtggtagctgaagggacccttgatcgaaagacgctctgccatgctttctgagtcctgtctcctccaagcttgtctcctagactgtttcccctgtctgttttcctgcgcccttgtgtttggccatttttgcattaggctgtgtctctgtacccaaggccacgtgacaaggtagttggaacccccactcaagtggtgagtgaagagcgtcgtggtaataataatagtagtaacacaacttccaaatttctcagtggagagtgtcacgtcctgggggtatcaagatctgtgaggcctttccaagccctcaccattccctctttggtcccacgttgggtgggcagctgggaaggtcctagttgattttaatctccggtgctttccccagaactgctgctctgaataaaccaaagctgtgaaagagtgttctgcgcaggctgcgggcccagcctctgggtgcaggccctgggcacttgagctgagcagctcagctggctctgctgtgagggaaagccgtgaacttaactgtgctgagagctgggtgagggcaaaatggggaagactgaagaagaaggagcaggtgggagagaccagccgctaacatggtgtctacttctccgtggatcagagaagggatgagtagcaaatgcagaggcagggtggtctcccagcaacaaggatgtccagagttctcctgaccctgtctgcacccacttccatgcaaggcagaggcatcacagttttccatcccaggccacccttcactcttccaagtgtcaggcctctttaaatctgcatccctttgggttagaagcaagagaggtggcaaagtctccctggcactgagagcctgtcccaccatgccactcggcatgagatggtggaggaagaagccaagagcagggatgccttcctgtccccgtggcctctcaggactccacaagatgctgtggaccaagatgagagatttcaggatggggccactggccttcctaggttgggctctgggtcctttcaataaactgttcctttcctgattcttactcccttctggtccttccactcccttccctctgccaggtatggaaaaggtggctgggctcggtgtgcgctccaaccccggtagcattagctgagtcacgcggcgagcacacaacagatttgtagcagctcatctgccatataaaccgcttggctgatggagtcctcattgagttttttcattatcgtgtaaagtggaatcatgtcattcacctttactataaacaaggctgtgagaacataataaacagaacctgaacaagc

SEQ ID NO: 17747 - DNA, 1432 bp, Homo sapiens
  ENST00000483095
gcttcagtatttactggatgtgacaagcagagagaagagctttcagtggggccgcttgctgcctggctcaagtggtgggagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcataggtgttcaaaagcggtggcattgggggtgggaggctgggggtgaggagggaatgaagggccattccaaagtatgacccagctgccggagcttggactctattccatttacccatgtttgtgttttggttagtggtagcgccttgccgctgtcacccttttctgggtcagcaacttgcccttcatataatgccttgggtcacctctgctgagagggcagatttgctgtgctaggctaatctgtaaataatgcaaatgcaattcccaccacctccacaccctcctcggttaggattcctgactctccacttgttgtaaatccctgggaggaatagctgaaagacttgggctcaactctgtgatttgtagtggccagctctgctcactgggatctcacagcttaggagagaggtttctgtggaattccaggtttctagttctgtcattgacaggtgacctctcagagaaggagtgaaatccatggagttgtttgtttcttccatttccattggaccagtgtgaaaaactgtgattacttcccatcttggccta

SEQ ID NO: 17748 - DNA, 859 bp, Homo sapiens
  ENST00000367557
ggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgct

SEQ ID NO: 17749 - DNA, 843 bp, Homo sapiens
  ENST00000367556
gggaggtgtgttgtgcatgcctgtgtgtgtatatgtgtgtgtgtgcccctatgtgttcatgcacacatgcccttcactcgccgaggatttgactgctaaaagaaagatctactttttccccagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttag

SEQ ID NO: 17750 - DNA, 781 bp, Homo sapiens
  ENST00000491420
gtgatgctgacactgctggttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatttcacaaaagaagagctgtgatcctgatgctattctcatcatgaatttcaaagcagtgatttgtttctggatcaaagaagttttggcatcactattagtatatgtatcctggattttagaaatgtaatttccattcttttcctctatctggtcttggaacccattcaccagcttattttctccagttgttcggggatacaagaggactctggtttttaggacagcattttcataaatagagaacttaaaataaattgtttttgttgttgtgctcttgtatttttccaagcctggg

SEQ ID NO: 17751 - DNA, 563 bp, Homo sapiens
  ENST00000508450
ctttacgctccccactcccggtgcagcagccaaccttcagccagcagcggggctcattagaagagggtcccctggacacttgatttttagctcactggtgactggaaagagttaatacctattctttgctgccccccgcacagcctctgggtgcagagggaggcagctgtgggctgtggggacttctccctgagctgcagccagaggagcttcagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattccttt

SEQ ID NO: 17752 - DNA, 566 bp, Homo sapiens
  ENST00000515211
cccttttcatgagatgcagagcctggagaggagcggagccggcaggagcagcatgttgcagccgctattctaggggcgctgggtgaagtgggctgccctctgccaccctctcccaggtgccaggaggaggtggctgactctatcactcagggcctcaccgaaccatgcccagctggggcccgcaccagccacaccttcccagctgcgctgcccaccgccaggtgatgctgacactgctggttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactggga

SEQ ID NO: 17753 - DNA, 2736 bp, Homo sapiens
  ENST00000638125
aagttggaggcgcctagtgagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttgattttttctaattccttagcaaaaatgctaatattttatttaggattttgcatctatattcacaagtgaggatttttttcctctcctgacaccaaccaattctccaacacaaactgagtgtcctacaattcaatttaattctgacactacccagagttagcattagcctccacagatttaaggcctcagccctacaagactgtcccaatcagactccagttgcaagtcctgggccacccatacttctgggcaactggttacaaattgggggttcttatgaccacctcccacaggcttgacaatttgctagaatgattagtggaaagcaagaaagtgcttaacttaatattactggtttattacaaaggatacaattcaggaaaagccaaatggaagtgatgcatggagcaaggcaagggagaatgagcacagagctttcctaccctctccaggcacaccactctcccagcaccttgatgtgttcaccaacctggaagctctctgaaccccatcatttagaggttttaatggaagtttcattacataggcatgacttttttttttttttttttttttttttttttgagacggagtctcgctctgtcgcccaggctggagtgcagtggcaccatctcggctcactgcaacctccaccccccaggttcaagcaattctcctgcctcagcctcccaagtagttgggactacaggtggacaccaccatgcccagctaatttttgtatctttagtagagacggggtttcaccatgttggccaggctggtcttgaactcctgacctcaggtgatccgcctgccttggcttcccaaagtgctgggattataggcatgagccctacatagcaatgactgattgaatctttgaacactggtgattacttcaatctccagccccttgtccctctcccctccccagaagtcagtgggtggggctaaaagttccaaccctctaatcatgcctagttctcctttttttttttttagttgtttatttttcttggcatgcagaataagagctattgtctaggtctttctggtgacctcttcatcctgaactacctagaagcctccagccactagtcatttcattagtatacaaaagacactcttgccattgtggagatttcaggagtttcgggagccatgtgccaggaaccagggacaaaacccaaatatttattttttctcataccacaatgattgacattggtctgtaattttttctgcttataatatcctagtccagtttttctattaaggttatggccacataaaaagagttgggaactatactctgttttgctattctttggtagagtttgtccaagtttatgcaagattggtattattcttttttttttagagacaggttctcactctgtcacccagactggagtagcagtgatgccatcacagctcattcactataaccttgaactcctgggctcaagcaatcctcccacctaagcctcctaagtacctgggactacaggtgcacgctgccatgccctgctaatttttaaatttttggtagaggcggtgccttactgtattgtccaggctggtcttgaactcctagactcaagtgattctcctacctcagcctcccaaagtgctgggtgtataggtgtgagccaccacacacagcccatggtattattctttaaatatttggaagaattaactgatgaagcaagccatctggggcttggaattctttgtgagaagttcttgaatagattccatttatttatgagatattggctattcagattttacttttttatgtgggctttggaaagttgtatttttcagggggtttgtctattttatccaagttgtcaatattttggtgtaaagacaataatattctcttatctttgttatatttgtgggatctgtattgatattcctttctaatattgaaaatttgtcttttttgtttctgttgatcagtattgtttggagtctatcaatataaataatattttcaaataacc

SEQ ID NO: 17754 - DNA, 1144 bp, Homo sapiens
  ENST00000637818
gagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtccagtcacatcttctatgcctatctcagctgctgacacgtgactcagctgctcccattttccttggaaaagtaggagctggaaaggacctcagtcagaggtcatccacatcaaccatctcatttcactgatgaggaaactgagacttggaccaggggaagtcagctgccatgttgtgaggacactcaagcaatcctatggagaggcccatgtgatgaggaactgaagcctcctgccaacagccatgtgagggcaccatcttggaagcagatccgccaacttcacccaagccttcagatgaatatagccctgaccgacatcttcactacaatctcatgagagaacctgcgccagcactacctagctatgatgctgcaaaattcctgacccatagaaactgtgagataataaatgcctgttgtgttaagccacaagttttgtggaaatttgttactcagcaataactaacatgagagttagctgaaggtcacattcttgttgagtagtggaaagggttttgttaacccttcacccactgtggttcacttgataaatgatagatgaataaagagtgaaaatgagcacaaaa

SEQ ID NO: 17755 - DNA, 563 bp, Homo sapiens
  ENST00000582940
cgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttga

SEQ ID NO: 17756 - DNA, 2308 bp, Homo sapiens
  ENST00000635833
atgacaatccggtaccaaggccggcagtacaggctgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaacttt

SEQ ID NO: 17757 - DNA, 761 bp, Homo sapiens
  ENST00000583473
tccccgtcgacgcccagggctggggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctgggtgagagctcatctggcactcagttatccgggacagctttgtgtacagcaccatgggagaaactaaatagagacttagcctgtgtttctgagaaatttacattttaattggacagacatgaccttcgtgtgtaaaagtaccagaatcaaaagcaaaggcaggataatttggggacgaaagagttattttgtacaaaatatttagagcataaataacagggataagtggggaggactcagtcaagaaagtcctggagggggtgctgtgtatagctggtcttgaaagaagtgatgcttgtgaattggtgaagaggagctctgagggtcttcctataaggggacactagcaagagcaatggtttagaaatggaatgagtggaaagtggaggagtgacaagggagattgagagtcatggctccagatggctatggagggtggcagagggg

SEQ ID NO: 17758 - DNA, 2078 bp, Homo sapiens
  ENST00000443584
ggctggggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaagtaagaacccgaaggggacgtgccgtatgcatgggtggctgtgggtgtgcaggcctctgcatgtgaatatgcatgctttgggctggggactgggatgggtga

SEQ ID NO: 17759 - DNA, 2387 bp, Homo sapiens
  ENST00000584234
ggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaaggcaactccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataa

SEQ ID NO: 17760 - DNA, 2384 bp, Homo sapiens
  ENST00000449996
ctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttggaa

SEQ ID NO: 17761 - DNA, 2375 bp, Homo sapiens
  ENST00000262406
gaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaacttt

SEQ ID NO: 17762 - DNA, 1472 bp, Homo sapiens
  ENST00000581175
tccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccaggtcatgagcaagctggaccgcaggagccaactccaaaaagagctgcctcctaaataa

SEQ ID NO: 17763 - DNA, 645 bp, Homo sapiens
  ENST00000577186
caaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagctatctatctatctcctgtctgtgcactctggctgctgtgga

SEQ ID NO: 17764 - DNA, 2238 bp, Homo sapiens
  ENST00000577595
ctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaa

SEQ ID NO: 17765 - DNA, 923 bp, Homo sapiens
  ENST00000467375
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggttcaagcgattcacccgcctcagcctcccgagaagctgggattacaggcacccaccaaaacacctagataagttttgtatttttagtagagatgaggtttcgccatgttggccaggctggtcttgaattcctgacctcaggtgatccacccacctcggcctcccaatgtgctgggattacaggtgtgagccactgcacctggccctattaccctactttctgtatgcagagctcatcagcaggctatccccacctcaccctgttctagacccaacaaaatgaagctcaaaatgctaaggatatagagagtgaggtggaaacttggacttgggtgtgaagcaccagagcccccacccaccctaggcagaaggggctacagctcctccctccccatatttcatccacagccctggctagaaaagaaggatagagagttgggagggaacagtccagagtctgacagaactaagctgttgcgtaagggtctgacctggctgcttgccatgaacccctgacttgcttctcctcgaagcctccttattacaaagctttccctggagtccagcctcttgcccctgtgctgcaatggtaggctctccttggacatacagcatttcatccctg

SEQ ID NO: 17766 - DNA, 1927 bp, Homo sapiens
  ENST00000451864
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggcatcatattggtcttatgcctcctagacccctgtgccctgtggcactgggtggcaccctcctccatggtggggggcagagaagcctcacagatcctcccctaccaccaccagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactgg

SEQ ID NO: 17767 - DNA, 1789 bp, Homo sapiens
  ENST00000537040
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 17768 - DNA, 1912 bp, Homo sapiens
  ENST00000613460
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 17769 - DNA, 1862 bp, Homo sapiens
  ENST00000612897
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 17770 - DNA, 2424 bp, Homo sapiens
  ENST00000618120
agcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatgggtgagtttcctcccaacccgtactgcagtcgtcatccatctggaatgacctctgtcattctctttcactgtgtgtgaccaagaaaaaagaatgaattcattcattcatccatattctgggagcaaaggaaattggagttaacaaaaccaacccagaaactgccttcctggtcctctatcaagtgcagcagaaggtcatggaacaaatgacttcaagagtgttacttgttactgaagggtcagtaagagataatgacctttaggatctatttttgcacatcaagggtgggcaaaagcaacccgcaaatggagtcttaaaaggtgcctaggtgtctgctggcctacaagggtgggaaggtgttccaggctgtgggcctggcttgagcagtggcctggaggtgagactcagcctggcatgcaccctcgagaccctcttggccacttcctgttccccagtgtgagttccagtgccatgagcagccctggccccgggctgcatccctctctctccctacccctgcctttcctctatctggtctccctgcagcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgt

SEQ ID NO: 17771 - DNA, 1984 bp, Homo sapiens
  ENST00000620376
tggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 17772 - DNA, 324 bp, Homo sapiens
  ENST00000494874
ggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagactcccagcactacgaggaccaagttcactggcaggtgcctggcgagcatgaggataaagcccagagacctctgagggtggaggaggcagacactcaggcctaacccactgccagcccctgagaggacacgctccttttcgaa

SEQ ID NO: 17773 - DNA, 720 bp, Homo sapiens
  ENST00000622297
tattctgggagcaaaggaaattggagttaacaaaaccaacccagaaactgccttcctggtcctctatcaagtgcagcagaaggtcatggaacaaatgacttcaagagtgttacttgttactgaagggtcagtaagagataatgacctttaggatctatttttgcacatcaagggtgggcaaaagcaacccgcaaatggagtcttaaaaggtgcctaggtgtctgctggcctacaagggtgggaaggtgttccaggctgtgggcctggcttgagcagtggcctggaggtgagactcagcctggcatgcaccctcgagaccctcttggccacttcctgttccccagtgtgagttccagtgccatgagcagccctggccccgggctgcatccctctctctccctacccctgcctttcctctatctggtctccctgcagcctggagagtgtgtttccactcatagccgagggccagcgcagtgccacgtcacaggccatgcaccagctcttcgggctgtttgtcacactgatgtttgcctctgtgggcgggggccttggagacccctgtgccctgtggcactgggtggcaccctcctccatggtggggggcagagaagcctcacagatcctcccctaccaccaccagggctcctgctgaagctaccctttctggactcccccccagactcccagcactacgaggaccaagttcactggcaggtg

SEQ ID NO: 17774 - DNA, 1862 bp, Homo sapiens
  ENST00000560081
gccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaatggtgtgaa

SEQ ID NO: 17775 - DNA, 1982 bp, Homo sapiens
  ENST00000268122
ctcaaaagccccgccggcctccgagcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaa

SEQ ID NO: 17776 - DNA, 1014 bp, Homo sapiens
  ENST00000558360
ggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggca

SEQ ID NO: 17777 - DNA, 1405 bp, Homo sapiens
  ENST00000558030
aaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaa

SEQ ID NO: 17778 - DNA, 1388 bp, Homo sapiens
  ENST00000558184
gcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacgattctccagggtgggagtcgtccaagtgtcatacataggagggtctcccttcccctacgacaaaggctgcagggacttgaggctagactttcctctgggggcagggtccgaccgggcccggcacatcaaaatcgcccagccctgtgtcctgagagaccgcagcccacgggactctggtgggagaactgggatgtctgcaccagcctcagaggctccttgtgaaggaaacaccgaatggggactccagccaaatggagcctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgtaagtgccccaggcaaggggctgggggctagagaatgctgaggtctttgtgttcctgacagtgagctgagggttcctagggagggggctgagggctagagaatcctgg

SEQ ID NO: 17779 - DNA, 591 bp, Homo sapiens
  ENST00000559638
tgggggcatttagcccagaaatgggggtcagggtagacttcctggagtggtgtggaaggctaagtggggggtaaggaaggcagggagggccttccaggaagagcccctgcatgactaaagctgcagaggtggaaacagctgggtgtggggtcatctctagagctaaaggacaggatgcctgcctgagctgtggggctgtatctaatgcctctcctcccgggcccattgggcctgtctggtctgaccaggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgtaagtgccccaggcaaggggctgggggctagagaatg

SEQ ID NO: 17780 - DNA, 2075 bp, Homo sapiens
  ENST00000262187
ggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgca

SEQ ID NO: 17781 - DNA, 900 bp, Homo sapiens
  ENST00000472642
ggccgccgaggagtccgggtctcgtctggggaagtgaggcggcgccggggagccgcgctagaggctgccgcgagggagtcacacctgcctccccgccttcgccgcgggcgcgcgtgaccggggctggcggtctcccccaccccgcccccgatggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgacc

SEQ ID NO: 17782 - DNA, 1153 bp, Homo sapiens
  ENST00000478470
ggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtgggttcctcaagccaggacctacgcacctgttgtgagtggtgttatagttctgcagggcgcacaggtgcatccccatgggcacatttaatttagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtc

SEQ ID NO: 17783 - DNA, 744 bp, Homo sapiens
  ENST00000496004
accggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctga

SEQ ID NO: 17784 - DNA, 764 bp, Homo sapiens
  ENST00000470072
agtcagggttgctgagtgtcagatgtatgcacatgtgaatggattgctaggaaaaaacaggagttctttgtgttcattttatgttatgttaaaatggtgagtctgtgacattttacatttttccagctggcaacataacatacatttaaaaacttcaacattaaaatggatgtctaatttatactttttgttttatagttttgaagtgattaaagttatccatggcaaattgttggatatggtggggaaagtacagtaagtagtaccattttatctgcttgttagagaaacttcttttaatagtatcttctgagcaatacaatctggcacttactggtttgtcttttttttcttacaaatagaatacctattatgttggttgggaataagaaagacctgcatatggaaagggtgatcagttatgaagaagggaaagctttggcagaatcttggaatgcagcttttttggaatcttctgctaaagaaaatcaggtaacagattctataaacctcattttgcattgcgttctcatcagtcgcagggatgtgttccttgcagttggcatttgacctctgtcttgatcactcctgtgtaacatctggccttcctccatttctaataccaagttttgtgttgctttaggaagatactacttaggtgtttataaattcagtcagtattctacttacagtggaacctaggatatttgtaggataaacagaaactattagtaaaggaaatactaccttttgtaaacatatat

SEQ ID NO: 17785 - DNA, 501 bp, Homo sapiens
  ENST00000470370
atggaggggttcaaagtcactaattgttcaaatatcaacatggaacctgggatccagcctttattggcagcctgaatccatgctcttgtctctgttctcttgatttcctcctctgcattttgaggagttgggaccgcgaggtgttctggctcttgggtgagccttccctagtcagtcaaggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatat

SEQ ID NO: 17786 - DNA, 557 bp, Homo sapiens
  ENST00000482053
tccatcctagagtcatcggctcattgatctgattgaaagccaagagatactggcatcacccagagaatgtatgtacctaggaaagaacacaggagcaggctgaatgtactagggcactctaggaaaagctgttcaagttgtaatgtaaacagttggttctttgctgaatgagttgggtgattaaaatttgcatttatgtggtttctcagcccagtggtaggctttccgtttgaatgccttacctgtttcactttgaatatcctcagtcagggttgctgagtgtcagatgtatgcacatgtgaatggattgctaggaaaaaacaggagttctttgtgttcattttatgttatgttaaaatggtgagtctgtgacattttacatttttccagctggcaacataacatacatttaaaaacttcaacattaaaatggatgtctaatttatactttttgttttatagttttgaagtgattaaagttatccatggcaaattgttggatatggtggggaaagtacaaatacctattatgttggttgggaataagaaagacctgc

SEQ ID NO: 17787 - DNA, 2372 bp, Homo sapiens
  ENST00000272233
atctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttcgcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttataaaa

SEQ ID NO: 17788 - DNA, 4473 bp, Homo sapiens
  ENST00000337910
ggggtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 17789 - DNA, 4339 bp, Homo sapiens
  ENST00000357917
ggcgggacccagagccgccgcgggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 17790 - DNA, 376 bp, Homo sapiens
  ENST00000496237
atctttccttcaccagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaa

SEQ ID NO: 17791 - DNA, 447 bp, Homo sapiens
  ENST00000461910
cagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaa

SEQ ID NO: 17792 - DNA, 518 bp, Homo sapiens
  ENST00000490827
gaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcaggtgagactgtgtgaggcccccattcatccagctctcctcacctctcatggaagcttttatcttctatgtccctggaaaggaacatggtcagcaggcagctcatggatgattcctcgagactggctggtggtcacatattaatacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagag

SEQ ID NO: 17793 - DNA, 475 bp, Homo sapiens
  ENST00000483488
tcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcgggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagatttgttcagttgggaagctgaagcaggtctgcataggatatatgaacttaaatgcctttctctgg

SEQ ID NO: 17794 - DNA, 575 bp, Homo sapiens
  ENST00000515852
accttctgccatgattggaaatttcctgaggcctccccagaagcagaatcctgtacagcctgcagaattgtgagccattaaatctcttttctttataaattacctagtcgcaggtatgtctttatagtgtgtgagaagagactaacacaccagtagataatctaaggtagatctcctttacatcagacagataactcagctaatacagttggtgacaaaggagactctgaaggggaggagccaggggaagaaaatatcctgtctcattctgctgcctctgatctctgcattgactaaacctaactagaagccagaggccaaaggaatctgtcgatatacaagctagcttcccagtggatggagcaggatggagaagaggaagaacgggcctggagggacaaacaaagggttaaaagaaaaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgt

SEQ ID NO: 17795 - DNA, 560 bp, Homo sapiens
  ENST00000510226
accttctgccatgattggaaatttcctgaggcctccccagaagcagaatcctgtacagcctgcagaattataactcagctaatacagttggtgacaaaggagactctgaaggggaggagccaggggaagaaaatatcctgtctcattctgctgcctctgatctctgcattgactaaacctaactagaagccagaggccaaaggaatctgtcgatatacaagctagcttcccagtggatggagcaggatggagaagaggaagaacgggcctggagggacaaacaaagggttaaaagaaaaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaa

SEQ ID NO: 17796 - DNA, 1511 bp, Homo sapiens
  ENST00000504949
attgactaaacctaactagaagccagaggccaaaggaatctgtcgatatacaagctagcttcccagtggatggagcaggatggagaagaggaagaacgggcctggagggacaaacaaagggttaaaagaaaaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtatcttgtcaagtggttctggttacttacaatctcataagctttggaaatgaaatgtgcctgtgacactcaagggtactggttagttttacagtggtctttacctaccatctgagattaagattatacatgaaatattatttgctttatatataagaattggtccaagctttctgttttccttacaaatgtacttgcctcatcttttccctatcaatttcattttattgtggtaaaatacatagaacataaattttaccatcttaaccatttttaagaacacagttcagtggaattaaacacattcataatgttgtgtaactatcaccacc

SEQ ID NO: 17797 - DNA, 547 bp, Homo sapiens
  ENST00000506959
gacaaatgagaaagcggcagacgtggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaact

SEQ ID NO: 17798 - DNA, 1432 bp, Homo sapiens
  ENST00000506817
cgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggtaaggaagagcagctgctccgcgctgaggctgaagaagcttttctttccttttttttccccctcccccttctgcccacttccgtgagtgtggagtgtccgcgttacatgggtcaaatttttaaacatttttgagaaaatctttggtcctttgtttcactgggcagggaacagccctgtcagagaacactcttaggaagatagaaggccccagtgggaatgtggagcacttactggtacacttcacgactgtgggttgacccttggtaggcagcagacagttgaatgtgccaactccaagggacggggtcactaagtttcatcagcaaaaagcagtgtttttttatgtctaccctatgggtgatagtgtaatattggtgttctaaaaatacatccctctcaaagctcaacacaggcaaaaatacttttcactgggacagttcagaaatagttcctctggaaagcggaggaaaagacagggactgggagttaattttaaatgactcatttatagcactattaattgatctctgaaaacttaattttaataatgcaaatactctttatgtgttagccatttgtcttagtgactcataaatcagaaataacattactaatgttgtttggaaaacttttaaaaaattaaaatttgtaataattgaacaaaa

SEQ ID NO: 17799 - DNA, 5537 bp, Homo sapiens
  ENST00000379982
ccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaa

SEQ ID NO: 17800 - DNA, 483 bp, Homo sapiens
  ENST00000512878
gcgtgccgtgcgccccagggacaggggctggtgcccatcctcgccgcgcgctgtcccccgcacttcctgttccgaggagagacccgcgcgctgaccgtgcttcccttctcccctcgccccctctgtccgtgcaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattcca

SEQ ID NO: 17801 - DNA, 333 bp, Homo sapiens
  ENST00000510623
ctggtctccggggacgagagcagcttgttgctgaacgcggccagcacggtcgcgcgtccggtgttcaccgagtatcaggccagtgcgtttgggaatgtcaagctggtggtccacgactgtcccgtctggaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaa

SEQ ID NO: 17802 - DNA, 693 bp, Homo sapiens
  ENST00000502541
tgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatc

SEQ ID NO: 17803 - DNA, 883 bp, Homo sapiens
  ENST00000504179
aagactcatagggtttcaggaccttgcagcttctcagcaatggagctgagttttcacttaggcaatttgtttactgctgtgaatgccaaagagagcagtgttgttcactgacaggcagcccatacagttcttaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaa

SEQ ID NO: 17804 - DNA, 990 bp, Homo sapiens
  ENST00000510313
ttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcaggtagattgctaatttctgttttgaaaagaaaactttatgttctttgttcttagatttgagacataagttgtagaagtagtacttttagcaaaataagaatagtcaatgtaataaatttcttgtaaattatgcagtgtggtaattgaggaaacaatttatagtcacctgtgttacataagtgccttaacctgtgttacacaagaagttttctaatgattattttatagctccatccgtttttaaatgcattttctttccctgaaatagataaggtgacaaaatgtgtcctcaggtgacatttggttgtgaaaagtgatatcttagttctaactacctaagtcagcagcaaagtttaaacagtacagatttaaaaattttttataaaggaatttaactcttgttaactatattatatttagctttattgtactggatatctgtatttactgagtatacctatatgggagtcccttatattactttggaataacagtttttcatatataaaaaatgttgtgaaactta

SEQ ID NO: 17805 - DNA, 492 bp, Homo sapiens
  ENST00000507186
actaagtaacaaattgttgtcttgacttgcaaattgttggtttcaaggtcaacatctgaactttctttattgctccctttaaaattaagaagtttctggattaatggtagttatcactcccaaattcagattctgcatatcagcctagctgtccctaatgtggtagtctaattagaaggaaaattgctggaataaccctgcaggtttatctcacttgtttcttgtttcccttttgaacctttcaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctg

SEQ ID NO: 17806 - DNA, 474 bp, Homo sapiens
  ENST00000511558
aaaagaagaagaagaaaggaaagaaaaaaaagataaaatggaataaaagtgcagaatgctgactccctcgaggcttttcctaaccattctattctatggtggatgctacggtcagcatgtttttttaattgttgttttttgttggtggggggtgtttagatcattaaagaaatggtttcatcatccactttctctcatgtcccttttctcatcagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatct

SEQ ID NO: 17807 - DNA, 653 bp, Homo sapiens
  ENST00000503737
cgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaataaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaa

SEQ ID NO: 17808 - DNA, 591 bp, Homo sapiens
  ENST00000513091
ctacctcatcttcagtcaaaagcctgaatttcaggatctttcaggaagttttatggtgaaaccagagtatcttcaaagaggcggggccaaggccagagctggacaccacgactgccacgtaagaggaatcccaagcatactgcgatcaagggaagggaagaaaatccactcccagaagcagctttttactgtgactctcatcgttactagaattaaaatggcaaaatgagaaagccagattctgagtcacggagggggagctaagtgacagctctgtccagagaaaaggatgtggcagggctgggaggcccctcacgtggtcagggctccggacttcccacttcccacttccctccaaagtaggctctgccacagagtctgagcctcctctcttttttcattcttttacctcagaaccctgtggccaggctccttccagaggcccctgccaggaggtccagggtctgtttcagggccctcaggctgttgccttaagttccctcagcctgaggtttatccacacgacttgcacctgctactcactcagagcctttctcttctccggtctgttgttggctcctcccttcctgg

SEQ ID NO: 17809 - DNA, 496 bp, Homo sapiens
  ENST00000514198
catcttcagtcaaaagcctgaatttcaggatctttcagtctttttcttaaaacttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaa

SEQ ID NO: 17810 - DNA, 1129 bp, Homo sapiens
  ENST00000308831
attcctgccccgccgggcctgccccgcgcagtctgggtctctgcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatca

SEQ ID NO: 17811 - DNA, 602 bp, Homo sapiens
  ENST00000533360
gcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtttctccctaggtgctggctttgctgattatccatatcagagctcaggctggggagcaagagagtggtccactgagagggccagaactctccagggctcacacatgccccccacatgccccctcgcccccctgcagtggtacccagaagtgaatcatttctgcaagaaggtacccatcatcgtcgtgggctgcaagactgacctgcgcaaggacaaatcactggtgaac

SEQ ID NO: 17812 - DNA, 538 bp, Homo sapiens
  ENST00000532559
cgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtg

SEQ ID NO: 17813 - DNA, 1837 bp, Homo sapiens
  ENST00000557447
gctcgctctaaccattccccctgcttctgtggcaggcagtaatccccgctttccatcctctagtcagcttcttcccagccagccacaagcgaacaggctcgcaagcagcggatgaaacaggaagtctgacagcttgagtctgcagtgggacccctagtgttttcccactccatgtcctggcatcgttccccagaagtacaaacacacacacacagagctcccattgttgcagccttcctcagcccactgatcctaatatggaattcagcaggaaacccatgatttcctgacactcggcaagctggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaattgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggca

SEQ ID NO: 17814 - DNA, 3302 bp, Homo sapiens
  ENST00000316754
cggcaagctggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggca

SEQ ID NO: 17815 - DNA, 580 bp, Homo sapiens
  ENST00000557133
tttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggtacatttttattatcttgattcattggagggcggtggtgtaggggagaaaaagatccatttgcttatgcagatgggactcatagcacagatattacccattctgatcatttggggccaatttattgtctgcctaaatgacgaccaaaagcacattct

SEQ ID NO: 17816 - DNA, 548 bp, Homo sapiens
  ENST00000555125
gagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcggtacagtcagatttgaatttcattttaaatgtatgctga

SEQ ID NO: 17817 - DNA, 4372 bp, Homo sapiens
  ENST00000366691
gggctccacggagtgaataggaggcggctcaggcttcctggctcgcgtgggcgccagaaagcggaacctcccgggccagtcgcgcggtggtcaccctcttgggagctggggaggaggctgcggaggctggcccggctccttcgggcgtcgcttcccggaccgggtgcgcggggtcccccggaacgtgtgttccaggtcctcccgcgccagtgttcgcagtccccgcctggtcgcggcggcgcctcgggcgcgggtgcaggcgcgcggcgcgcaggcggggggcgctgtggtcttggcgcggggaccgagccgctcggccagacccgcctcttttccctccccgccagcccgcccgcctgcccgccccccacgcgtcgtgtcgccgggaagccgggcggagacagagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaatataa

SEQ ID NO: 17818 - DNA, 3793 bp, Homo sapiens
  ENST00000544458
tttttttttttttttttttttttgagagggagccttgctctgttgtccaggctggagtgcagtggcataatctcagctcactgcaacccctatctcccaggttcaagcctcagccttctgcatagctgggactacaggcatgcaccaccacacccagctagtttttgtattttttagtagagacagagtttcactatatgttggccaggctggtctcgaactcctgacctcagctgatccacctgcctcggcctcccagagtgctgggattacagacgtaagccaccatgcccggctggaatcattcatttcttttcaagtgggtatcttatggtattttagggcatggctgggagcagttttgttttctcttctcaagactgagtgtttgcaggatgtcatagagttcatgtctgcagctcacagtgtcattgcctgtgtccccagctccacgtactggcaggtgtgctgcaagctgggtaggtgccctgtgtccctgggataccttaaccgacactcctggccctcctctgcaagctgtgccctgatcctccctgcagggactggggattgggtctgctcacctagaagccaggatacctggctgagggcacttctctccctcttctctttgaacagagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccg

SEQ ID NO: 17819 - DNA, 3500 bp, Homo sapiens
  ENST00000254260
agtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccg

SEQ ID NO: 17820 - DNA, 2378 bp, Homo sapiens
  ENST00000588388
agtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagagattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgt

SEQ ID NO: 17821 - DNA, 706 bp, Homo sapiens
  ENST00000588683
gcgcgatcttggttcactgcaacctccacctcctgggttcaagtaattctcctgcctcaggctgctgagtagctgggattacaggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgt

SEQ ID NO: 17822 - DNA, 562 bp, Homo sapiens
  ENST00000592247
tttcttgatgcgaacttacgcaaatacctattttgttaatggggactgattcaaggatttgagtgaacaaaacgttgacttaatttcaacaatactttttcaggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtg

SEQ ID NO: 17823 - DNA, 540 bp, Homo sapiens
  ENST00000591502
aagatggctttccaggttctcgcatgactgctgtagcatgtatgcccccagatgtgtcatttgtccctgaacaaggccaagtgagatcttcaaggacagcaggcaaaattccctttagctttcaagcgtctgatccagccttcaaatcctacacctaacgatgctctcttccaaagggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatggtgagcgctgacacctccctgggcagtcagtggtggcgtggagtgaaatctgcatgagttc

SEQ ID NO: 17824 - DNA, 468 bp, Homo sapiens
  ENST00000585641
agttattctcttaagggggataagtgggggctgcaagtgaagaaactaaaatggagtctgtccggctctctctgctaggagagagtcactcaggttaaaacaaggtagggtatcacaggctctagctatccaggcagatcctttagaaaagagaacatccaacctcttgggctgccccttgggcctttatgctctgcttggtggatctgcaagtcacgtgggtgctggcttccgtctgcagggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattg

SEQ ID NO: 17825 - DNA, 6321 bp, Homo sapiens
  ENST00000261655
atgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttat

SEQ ID NO: 17826 - DNA, 552 bp, Homo sapiens
  ENST00000540658
gagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgacgtagaagtctatctttctgatgctccatcccactactctcaagatacgccaatgcgctcaaaggcaaaaagggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattcca

SEQ ID NO: 17827 - DNA, 994 bp, Homo sapiens
  ENST00000536632
ctttgactaacatacaaacattttaaacgtgggctgtgcttagctttccattttgcagagtgtgtgggtcctgggaaggctccccagcatgggccatcctgcccctggcacggccgcagcccctgccccagcctgtgctctctgaggaggcccccgaggcccagccctgtctcaatgctttcacatgcagtgtggccaggtacagagtgtggctgtggttatgtgcttctccaattcatctgacctagacctcccgatctatttccacctacatgttaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgac

SEQ ID NO: 17828 - DNA, 3685 bp, Homo sapiens
  ENST00000535703
gaaaatgaactgaaggatgccacccagggagagtatctcctgagatcccatcatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagcctcagaaaaccaacctccagtgtccgcactttaggaagtgtcccatgctttcacagttgacgatgacgttcgttagcactcttggtttcaagcgacagaaaacccaaacaggaaattgtttttgtgcccatcactgaaaatgtggcttcagacatggctagatccagggctcaaatctgctggcctcagacccagtagaatccaaggcctccccgacatcaccaggacttggctgctctctgccctcctctggatcagcttcagccttggtttccctgtggagacccccagccactccagccctgaccctcctggtggcaaagtggctgcagcctcacctcctcccaagccaaagtccaatagaaaggggcttccctctcccgcagcattctcaggcagaggcccattgccctccgtaggccccacaccacccaggtcaccagtcgctgagggttcagactgtgcttggcacaggggaggtccagaccccagccagtccagaggttcttcccaggagaggagctcctgacgctggaggaagaggcctgaggaacaggcctgttacccagaggatccgctatccaggaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaa

SEQ ID NO: 17829 - DNA, 770 bp, Homo sapiens
  ENST00000544568
gtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaaggctcaggttgaggctaagaaggagcatgaaggcgcagtgcggctgctagaggtaaggagcgtgcccctgctttctgcccgggggtgggggacgttggggagagttgccctgatgcctgctagaaataatagatgatgtttatgaagtgcgcctggtgcaccagttactagatgccattcatgtgtcttctcatgtcatcctcacaagcaaccagtactacaggtgccaggaccaggtccgttcttacagggaaactgaggcacagagaggttaagcagctttcccttggccacacatccagacccagaactgtgtgtctcagatgtggtctgctgtcctctggtggctcctcttgggtggaaagtgagggggcgtggctcactcgcttgcttgtgaattaatttccccaggggtaaaggccggtggaccttccggaggccatcctggtctctgatgaactgccttggggtacctttttaaggtatgacacccatcctggggaggcatttgtaggatcagagaaaggagggcctggggaatca

SEQ ID NO: 17830 - DNA, 5047 bp, Homo sapiens
  ENST00000491071
ctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatggctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacac

SEQ ID NO: 17831 - DNA, 4428 bp, Homo sapiens
  ENST00000517960
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 17832 - DNA, 4116 bp, Homo sapiens
  ENST00000518273
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 17833 - DNA, 3876 bp, Homo sapiens
  ENST00000522291
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 17834 - DNA, 5079 bp, Homo sapiens
  ENST00000521978
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagctcaattctgcctgcacatactaagaccaaatcagtgactagacaggacatttcccttcatcatgaatgctttaactcaacagtattgagatttactgatgaaatactggttagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacaggcactccagaaagtctgaaagatctagcatccaaaaacagactaggaaaggcactgcctctgatgcagaaagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 17835 - DNA, 4442 bp, Homo sapiens
  ENST00000520567
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgtttt

SEQ ID NO: 17836 - DNA, 7055 bp, Homo sapiens
  ENST00000264839
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 17837 - DNA, 3489 bp, Homo sapiens
  ENST00000517433
ttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacaga

SEQ ID NO: 17838 - DNA, 3542 bp, Homo sapiens
  ENST00000401910
agtaaatgctaccagtccccacaccaccaggcccaccgaagcttgtctacagtattttatccaagcagtcctttgggtaactgcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatc

SEQ ID NO: 17839 - DNA, 3097 bp, Homo sapiens
  ENST00000523963
gcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgtttt

SEQ ID NO: 17840 - DNA, 2799 bp, Homo sapiens
  ENST00000425662
agaaaagcctgaagaagcacttttgcctgtgttcccaacaatcaattgtgtatactcttggtttatgctttctggtgccagttgtcattgagctgagtaagattcctcagttagggaaactgcagaggaaatgatctgttacacagggcttggcaggaccattgccagtgattgataatgggaccaaatcatttcaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacaga

SEQ ID NO: 17841 - DNA, 2500 bp, Homo sapiens
  ENST00000453976
gattcctcagttagggaaactgcagaggaaatgatctgttacacagggcttggcaggaccattgccagtgattgataatgggaccaaatcatttcaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatag

SEQ ID NO: 17842 - DNA, 2276 bp, Homo sapiens
  ENST00000524197
gtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggtataaaataaagactttcttaatttcttatcatttgtactagtgatttttttcagtcactttgttttgtttcatgacagccttacaggtttattcattcatgtatactttgctaactgtctacatttccccttcccttattatacatgtctatttagagatatgcgtatgtggataaacccaagggtacacatacacatatttctatgaatgttgttgcaaatggcgtggtgtaatttgtaactgcttctggctgctgctttt

SEQ ID NO: 17843 - DNA, 3065 bp, Homo sapiens
  ENST00000517827
gtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaa

SEQ ID NO: 17844 - DNA, 2223 bp, Homo sapiens
  ENST00000370420
cgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 17845 - DNA, 2285 bp, Homo sapiens
  ENST00000522211
cagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagaacaagaaaaatataactcttccacaaaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttg

SEQ ID NO: 17846 - DNA, 1513 bp, Homo sapiens
  ENST00000463023
gtgcagtgagcttcttatgctgcccagagcaaaacgaggacgaagtgcagaatgcctacatactaccaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgct

SEQ ID NO: 17847 - DNA, 1842 bp, Homo sapiens
  ENST00000431478
attatggaggtgaggaggagccacacagaaatatgctcttacgagtcgggccacaaaaagttaaaaagtaccatccagagaagcacagaaacaggcatggcagctgaaatgagaaagatggtaaggcagccgagccgagagtctactgatggcagcatcaacagttacagctctgagggcaagtaagtgctgtcagcacgtctgcatggctgtggaaccaggaattgtgtactaatcagtaagataacaaagccactgagtgttactgtgcagcttctctatttaatcagaagttcaaccatccattttaaaccaccctgatggcttataatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaa

SEQ ID NO: 17848 - DNA, 1787 bp, Homo sapiens
  ENST00000414192
agttcacaggcagctcagacagatattccagccagccaccgcacaagttatttaaaccaggtcaaagcttctttggcattcagttttccccagagaacaatttaatgctgatacttaattttttcaagatagacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaa

SEQ ID NO: 17849 - DNA, 6674 bp, Homo sapiens
  ENST00000370419
ctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccaggtaaatacagggatttggtaatggtgactgtgtgtgatgactctctttccattctattattcttccgtctctcccttagtggtattattacaagcaagtcaaataaatttcccaagtatttgaaatttgttttgttttatattgaggttatggaaaaggttccaaatatatttcagttccgattcaggctgactgctttgccatctgtagattcaaaaatccagagactagtgggcctctctgggactgtttgcgttcctaaaactgaggaaccagtttctgcaattaaaattctaaatgctcactgtgagtgcccccaactttcccacacatattcctgtctagtcacaagaggtctaatctgtgtatggcagtgtcattgtttcataattgtaagtttgctctgttttagccttttttaatttccttttagaatttattgttgtttatattctgtttgcttttgataaaatctttaacagttcacttttaatggctgagcttcagcttctttcttgatgaaaagtgaagatattcaacctgatcttaactatcctagcccaccagttgtcagaaatgctgcagtacaaactttcccacaaaggcatataacagtatgaatgcctctttagaagcgacaaaagatataatttttgcttctaaattggagcttagagcctgatgctttatgttaatctcattacatctttaatttcatatccaagtaaaacttcttacagattactcatggaacatattctataaatacttaatgtatatttgaaatgaatatagaagttaaggaagtagtaagtcagtgaaacaaactaacacaaaataatcgaactcaaatattttagccaataaaaagcaagaggaaagagaaagaaagaggtattaccgcagtacttgggatgcaaagacaaatgcatgatttattatgtctgtgtgtaatatgtagttctgcccaataatgcaaacaaaattgggctaataaaaattgtttgaactttttacagtctgaagttatactactcataactactgccatgtttgcttggagtgccacaggaaaaaatcgaggaaatattagttctgcttgctgagaaaaaaatgtaaaatcatgcatattgtaaaaacctactgaaggtcaaagcatgaactatccaggtttattattacttgttcttgacaaacagtttcttaaaataatggtttatttactaattctgaaagttttctcacactcctcttgatgtgactaaagcttcaaaagaaataaaaaacatgcacacaaaacaaacacaaaaaaaatccttatattttaagctacttagtgtgtgcctggcactcagtgtgtgaatatttctaggatactcacaccagtggtctaaatataataactaaaaatatttttctttcccttattttgtacttgtaaaatattatatacttatataatattatataatagttgcatcattttatataatcttatacttaagattggtgctttgctaataattctgagctccacaagtcctatttaatagtctctgtatgttgactttgcatttcctgatttaagcaaataatcatatttgtatgtatacaatttaaaaataaatgagtattcagcgaggcagataacatcctgtggacaggtactacgacaataagatagggagtggaaggaagctgagctagccaaatgtgtcagtgcgaaacatatgtcaccagtgtcttttctccttcctgtctttcattctctaatgtgtaatgctaaaagtatggagatagagacaacatgagttcaaaaatacgtgcatgtatgtatatataatctcttctgtgtttatattcatgtatttataaaaacattaatttatatctgtataaaaatgaatgtcaaaatgtgtacatataaataaccacaactttatatggatatatcaataatatagtttggtttcatataaactatggacacttattatttctataactatccatggctaaaatctaaagctttcaaaatacatcataccatgttcacttaggacttataaaaataaaatctgaggatttactagtctctagtaaacataaggaaaataacatttatttaataacaagcacagtgttaaatatttaatgtactttgtcaatttcctgacaataattatatgttatgaatattattatcctgattttagagatgaggaaaaaagctacgaaagtttattttacgactaatagagtaaggattcaaaatcagatctatttgatatcttctgtttaactagtttttccaaaaatatgaaaacttgtcctatgagatgtttcaccaataagagtttttgtgagtcaaatacattttggaaactttgcaactgaaagtgtctaccttgaaatttaatacacacagcatattaaagtcatgttctaaagaaatctgtatgtttagtttcttttctcccaaattgtttaatttcccaacctttttttagtaaaacgtgtctcgaggaagtggtagtatagagaaaatgctatagttgccttactgtatcctactgtgtcctaaatattgtgtacatgttaccacacacccctgttaagtggaagttatttcccacattttgtggatgtagaaacaggcttggagacttaatcgaattacccaggtcacagccaataagtggcaaagccaaggcaggaacttgaacattcagactataaattttgtgctattttctagctgtttcccattctatgttgatcccattcttgaaaaaaaaatcacttttgaagcaatgcttagaaaagttttatagcaacctattactaaagatatttgcctgaggttaggagttgaaaagaagagtcgactgtctagaaaggaggctaaatccttagtttcagtaaaatttgtcctcaacttgtacttaataaggaggaagctgaagcgggcagatcacttgaggtcaggagtttgagaccagtgtggccaacatggtgaaaccccgtctctactaaaacacacacacacacacacacacacacacacacacacaaattaggtgggcatggtggcaggtgcttgtaatcccagctacttgggaggctgagagaggagatttgcttgaacccaggaggcagaggttgcagtgagccaagatcacaccattgcactccagcctagataacaagagtgagactctgtctcaaaaaagaaaa

SEQ ID NO: 17850 - DNA, 7235 bp, Homo sapiens
  ENST00000372684
acggtggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggt

SEQ ID NO: 17851 - DNA, 1408 bp, Homo sapiens
  ENST00000372683
gcctcggcctgtggaggccccctccctgtctggaccccggccccacctccggaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaagga

SEQ ID NO: 17852 - DNA, 5203 bp, Homo sapiens
  ENST00000372851
caagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgacttggccggttcttgacctggtggatgtggctgcagtccagagaaaggaaagattgaggtggcagagcagaccactctcccttcccaaactgtccaacttctccccctttttgcctcctcggaagctcgctgcccagagccatgtccagaacccagccggccatctccatggtgccaattaccagcaagtgtctttcctgcggcaccgggttcaggcagctactcctgccccagagatgaaggggcagctttgcaaggatccggagccagctcccaggggcccagagccccccacttgaagaggagcttgagcttccctctgcctgcccgtggaaggagctttgccgcagcctgtccgagtccatccgtccgtcccctcctgcctgcccctcttctggtggctctaggaattggggttcagcagggaccaaaggaaaggaggaggtgccgggggcctggcacagacccctaggtgcctcgctccatgggattgcaacaagctagtttaggaaccgctggcggactagaaagaatgttgtcgtctgtgttccggtggaggagctgtggaacctgagtttccagaaccccaaccctagagagcatttgggggtgctgtattggagggggaggctaaggaaagttgggattgggactggtggtgccaagataagggtttctcaaattggagaacccctccttgttgcatgaggtcaatggtcatcctgtctacccaccctgcctccaggccagggggctggggaggcaaatagagcccccctattttagtctttttaaaaaaaacatcctatactaagggcagaacccactgccccggcctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccatgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttctaa

SEQ ID NO: 17853 - DNA, 1036 bp, Homo sapiens
  ENST00000541604
atggagcgctcgcagagccgcctcagtctgtccgcctccttcgaggcgctcgccatctacttcccgtgcatgaactccttcgacgacgaggacgcagaaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgactt

SEQ ID NO: 17854 - DNA, 4505 bp, Homo sapiens
  ENST00000255006
ctttcagtggtgttgttgaaagggcttggcagctcccaaatgtttgcagtgtccttagtcctatgagggctgccttcttcttcttcttcttctttttttttttttttttttgctagcttttagctagtatctggaaacatctactggacatgttggactcattttctcaagaatccactttacccttcagggaagccaggaaaagaacaagcttccaaccggtacaagtctggaggaatttcacagcctctcaaactacggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatcc

SEQ ID NO: 17855 - DNA, 437 bp, Homo sapiens
  ENST00000459721
cagtctaggaactgcgctggtggggacaggaaattgggctgaagggagatgagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccgggg

SEQ ID NO: 17856 - DNA, 871 bp, Homo sapiens
  ENST00000467569
tgcgctggtggggacaggaaattgggctgaagggagatgagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagaacccggaaacctaaaattgtctgtgccatatccacctactcccaatgatggaaacagtaatgcagcaagatccagcgtgtgcaaagtagaattcagtgtagccgtgtgagtctccagaaggcttacaggggagcagctaaagaggatggactcattttgcattctcagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaa

SEQ ID NO: 17857 - DNA, 462 bp, Homo sapiens
  ENST00000488077
gggctgaagggagatgtaaggccttggtgggaaataaatggcactgtgttgttgacggaaaaagatcttggcaggactgttgttgtgagtgttctgtggcttagaaaggaatttcctacaggctggactaaccattaaaaatgtctctaccttcaggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagaacccggaaacctaaaattgtctgtgccatatccacctactcccaatgatggaaacagtaatgcagcaagatccagcgtgtgcaaagtagaattcagtgtagccgtgtgagt

SEQ ID NO: 17858 - DNA, 281 bp, Homo sapiens
  ENST00000465815
gagtccccggcgtgcagtggagcctcgctgggggaaatgacagcttggaccatgggcgcccgcggtctggacaagcgaggaagtttctttaagagaataacagaagagctctctgacaccacaaagactagacctgcgactagctttgaagaaactacattgctgaaatctggctataccgaatagatgaaccagtgggtgatgattcacttgacctcagctgagttccctcaactattggtctcttcttggcatttgaaaaagtattcaattttcaaaaa

SEQ ID NO: 17859 - DNA, 4053 bp, Homo sapiens
  ENST00000484638
cggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatcc

SEQ ID NO: 17860 - DNA, 1837 bp, Homo sapiens
  ENST00000440354
gagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttcct

SEQ ID NO: 17861 - DNA, 1092 bp, Homo sapiens
  ENST00000326695
gttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 17862 - DNA, 1156 bp, Homo sapiens
  ENST00000589109
gttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccagcctacactgaaagagtttggaagggaagaattctgatggttgaagctgcttcttttcatatttggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 17863 - DNA, 870 bp, Homo sapiens
  ENST00000590910
cgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccagctgtgtgactggctgaaacacagatgggaagtagagctgtgggaaatcagaagaactgaaaagcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcac

SEQ ID NO: 17864 - DNA, 421 bp, Homo sapiens
  ENST00000594852
catcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtgagtgccgattttatctggtagcttctgtcttttgctctgaggatgcatagtacaaaatatggctgctttcccaggttcacactgaaaattatgagaaagaaattatgcacatgatttttctaataagtcatggtggtcccatggtaaattgtgttggcctccataatatattttaccacatatgctattttgcagagtgccctt

SEQ ID NO: 17865 - DNA, 1810 bp, Homo sapiens
  ENST00000268125
ggcctctcccctctcccctttctctctgggtcttcctttgccccactgagggcctcctgtgagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttggccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagagga

SEQ ID NO: 17866 - DNA, 609 bp, Homo sapiens
  ENST00000563254
tcaatggcttctgcatcattgagaacttcaagggctttaccatgcagcaggctgctagtctccggacttcagatctcaggaagatggtggacatgctccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaa

SEQ ID NO: 17867 - DNA, 782 bp, Homo sapiens
  ENST00000567787
gcctccagcggagggaacctctagagctccaggacattcaggtaccaggtagccccaaggaggagctgccgacctggcagggaacaaccaagactggggttaaatctcacagcctgcaagtggaagagaagaacttgaacccagccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcacc

SEQ ID NO: 17868 - DNA, 369 bp, Homo sapiens
  ENST00000564388
ggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcg

SEQ ID NO: 17869 - DNA, 6246 bp, Homo sapiens
  ENST00000372771
gcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccca

SEQ ID NO: 17870 - DNA, 540 bp, Homo sapiens
  ENST00000575165
gattctgagccgggctccatccctccctcctcggagccctgctacccgcagccgtgtctcctccccctgggcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgcccc

SEQ ID NO: 17871 - DNA, 1083 bp, Homo sapiens
  ENST00000574149
gtgtctcctccccctggggtgagtccagcagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggtgagggcggggcggggcaggagggaggcggggagcaaggatgggggttcctgcctgggggaagctgggtctggtattccggtctgtggggacaaggaaccgaccaactgatgctctcccttctctcccctgcaggagtctggtgagggcggccggccaagaggaggagaggcatccctgcagggctgcaggtggggcgccaatggcctcgccaggggcatatggatgtggagccaccccttcttgctggggaaagaagggaag

SEQ ID NO: 17872 - DNA, 3212 bp, Homo sapiens
  ENST00000461366
gggtgagtccagcagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaa

SEQ ID NO: 17873 - DNA, 547 bp, Homo sapiens
  ENST00000580109
aggctgggatgggtgcagtgaggccaggcaggtcagttgaaatggccggtcctggaacacagagcccggcagcccagccgggagggctgtccgcctgaggctggatccgccaggctgtggagggagggacaggaagaagcaggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagtctggtgagggcggccggccaagaggaggagaggcatccctgcagggctgcaggtggggcgccaatggcctcgccaggggcatatggatgtggagccaccccttcttgctggggaa

SEQ ID NO: 17874 - DNA, 426 bp, Homo sapiens
  ENST00000574782
gggtctgtgtgccctgggagtggagatgaggaaacaagcagcgcccctggctgagaaggaaggaaggaggcagcctgggttttcccgtggacagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcct

SEQ ID NO: 17875 - DNA, 1868 bp, Homo sapiens
  ENST00000256257
agtttcggaaccccagccagctcacctctgcgccgctgaacccgatccgagcctccggcaaaggtttttccctcctcccccggccgagggcttctgcagcccgggcacccccgccccgcggcgccccacattcccccagcccggggcccttggcgcgtgcgctccgtgcggctgtgctccgcgggactttgtttgtttcctcctcgtccctctttgttgggctgaacaccagcctcgtcaaagccccccactccggagggagttcggcttctccagcagggcggctgcagcgcgctgccccgaccccgcctgcggcccctcacgccgctagtgctcccaccccgccctcctggcaccccgcctgcgtccgttcgcccgaggaagccaaccgcgacttcattgatgcacccattccagtggtgtaacgggtgtttctgtggcctgggactggttagcaccaacaagtcctgctcgatgccacccatcagtttccaggaccttccgctcaacatctatatggtcatcttcggcacaggcatctttgtcttcatgctcagccttatcttctgctgctattttatcagcaaactgcggaaccaggcacagagtgagcgatacggatataaggaggtggtgcttaaaggtgatgccaagaagttacaattatatgggcagacctgcgcagtctgtctggaagacttcaaggggaaggatgagttaggcgtgctcccgtgccaacacgcctttcaccgcaagtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacct

SEQ ID NO: 17876 - DNA, 2637 bp, Homo sapiens
  ENST00000303545
gactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaata

SEQ ID NO: 17877 - DNA, 467 bp, Homo sapiens
  ENST00000517684
agtggattgtgaaatgcgtctactgtaataatatgcaatgtcttgattacctgctgaaataaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggca

SEQ ID NO: 17878 - DNA, 9501 bp, Homo sapiens
  ENST00000312828
gtgcacgtgcgcgcgcgcccgccccagttgcgcccccggcccgcacacaccccggctcatcttctcccggtccccttgtctcgcgccttctccagccctagaagttgccccagggcccctcccgggattagagagcgctgtgaagggccagatgttgggggtcttttgtgcagacacacgcgcctggggcgcttgctcctggaaggacagcggcaggacaaagccagctggactcgtggggcgctgctcgggaagcggcggtccccaatcccgcctggggtcggggcatggcttggggagcgctgcctgggtctggagagagtagagaaatcgccaaagcagagtgacggtgacttgatgaggtgacggtgacttgatgaggtggcggtgacttgatgaggtggcggacaggggcaaacgaaagaaagatgctcgggattgccgcgctgtgtgcctgtctgcgcggctgactaggcgccccgcattcccatatgaccgggttacctggtagattttgccagtgtgtctttgccccaagatgttattccccacctgctccgatttctttctttcctagggcttactgttgctagtaggcgctctgccaccagaggggaactcgtgggcgggggagactgcggaggaggggggaggtggttatttatcctgtagagacaattaggagccgtgacgcccccttctcggccgccagccctccacacctcatctgccttgctccacctccctagtgcacccgctccagccccgtctgcccaggagggcgcttggatttccttctccgcggcgcgtatctaacccttcctgcatgtatttcactgcaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtcccaggactctctgctggaatgtcagatctgtttcaattactacagcccccggcgcaggcccaagttgctggactgcaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacaccccggtcttcatcaaacttcccagcaatgggtgctacatgctgcccctgcccatctccaaggagcgtgcgctgctgcccggagacatgggctgccgcctgctgcccgggagccagcagaagtccgtcaccgtggtgaccatccctgctgaacagcagcctctgcaaggtggggctccccaggaggcggtggaggaggagcaggacaggcggggcgtggtgaaaagctccacctggtcgggggtgtgcactgtcatcttggtggcttgcgtcttggtcttcctcctcggcatcgtgcttcacaacatgtcttgcatttctaagcgcttcactgtgatatcctgtggctgaagagggctgcagggaagtctcttgtgggtgccaacttaggggttgagcaggttgatgatgagatcccagtgagaagatggggggcaacactgaccatttggtgctgagcgctggcctctgggttgcctcttgattaccccaagacagacacaaagggcagaaggtgcggtctcaacaagataccaggtgaattgttctgagtgttgatggcaacagcttggaagatgattgcatgcatcctcataatcatgtattcaatggactgtaatttatgatttttcaaaatcatgttacaagatagacatattctacttagacgttaaactgtacaagtgcgtacaatgtgaccttctctaaatgcggtagattcaaacaaagatgctctgtagacaagtagaattaaacctgcgaatccgtgtaaaaattcagtgaagacatgcactgctggcttctttattttttttttctttttattgaaacccagtcttcatttagttgctaaggcttttaatacattttgaatggcaccaaaacaaaataagtcaaaatggacagtcattttatttggaggaaatatttgaacaagtgtctccaatgtgttgtgttttgtcatgaaccttcattttcttcacttgtaattagagcttgctacgtgtttatggaactgaaagctcaacaggggagcaataaaccgagaaatcatgagaaatgtctaatcccatgggaaaacctgtatgccgattttcctcaagccatctcacaaaataagaatttcaaatgtaaatattgtgtatttgtgtgtgtatgtgtgtgtgtctaatttgatttacctcaggtgtttgagtctttgctgaagaatcctgggatgaagacttcattgggcatgaatgagtcaagtctctgaagcggtggccacttcttggacatcttgacccagcgagtggtctcctacacgtcacctgcaacactcgctcctcttctgtgtatttaagtcctgcattttgtaagaggcaaatggagagtaacagaagagtgtcttttctcctggttttggagtcttgcactggccatgagtgttgtgactgatggtcaacccaggcgggcattttaataaatggcctgtgattcttttttgaaagatgctcttccacaagagttaagccagttagaattcctgtttcctcttgttgatatgagagaagatctcctgtattttaacacgtttttaccaagaaaggtggcaaggtaaactaacagctcaaattcccaatataagtggaccagttcctcataaactgtcaaatgttcttaaatgtgtaatgatctatagatgctcatgaagaaagatctgctacaagtacgtgataaattcctatccctgggtgcatgtgcattcagaaatagctgtgagctttacagctctcatctaacttcttttatggaattcatgaagcaagtggtatgtgacaaggactccacttataaatataactgtttttatgttccactgaatccctgaaaatggtgaggagggtggggggaagtgaaggaaagacaagcagggctaattccaaaaagcaaggctagaaaatagccctgtgaggtcaagacaatttaatttatttacatgctgtctgttatcttcaagcagcacaaaatatgcatataaaagtgatggaattaatgtgaaataaaacaaaaatataatggctagaatacaaagctaatactgctaattggcatgagaattcaacataaaattgtgagctctgatttttcaaattgatcataaaacctttaggaaatgtatttgaaagctcaaaatagaaattaggttaaaatgccattttattgtgtaagctcttgggcattatacaacaaataatctaggatttatttggtattaataatttaggtgtcatattagctgaatactatcctctattacataacataatatactgttgggttagtgtcaatttctcaaactctcccaggctgccataatgcatgtctgacctaatttctatttctcttggaggaaaatacacacacacacacaccacagaagtgttgcattaagaatgctacatttcgaatagactttgcccttgcaattttaagctatgccatattcagattaattttgtgagtgatatctgcatatgtttctgtacagtgtgaaatgactgaccctgtagtatagtacgtgatagagttctacttgttaaagtaggttagatatagacactaatgtgtgtgatgatagtgtcctgtgtttcttagtgcaaatctgtagagtaaaaatgtccatagaacttttacttaaaaacaatcccatgctagagttgccattaagcagtgcaaaattaatcggctgtatggtagattcttgaccttaaatttaacaacaacaaccaaaatcagattttttttgtgagtcttactgacctaagaaacattgtttaaattgtttaaatggatctgcttgcagttatttgtgtacctgtttgttggggtgtgcattcttgtgtatgtgtgtgtgtgtgtgtgtgtgtgtgtgtgtgtgtgtgagagagagagagagagagagaatctcagtctcccagatagaattttataggcttaatgatgttttaatgttgcttggcatcccattgctctggcctcttctggcatttaccaatgacccttaacaaacacatctacccatgtgaccaaagtccactgacacaagaggccaggattcatacttgcacattaatgaaaagtcacaactggaaagcacagaaagagctgaaagcagcctccggtggcttcattttgtagatgagtccgttttgtaattctgcagaaagggggggatatgaacttcgcactgcagtgtcttcttgctccatcctaggtctgtctatatctctatctggctatgatcctttctagggttgatgaataccctttactgagtcaactattgctttaaagaattttttttgtaggtttatgtactcattttagttagcatctacctctctgggaaaatgaaaggagggttgacttagggatgagtatagatgttgaaagacaactatcaaaccatgtggtttgaatttttaaaattgtaaaacattggtgtccaaacctcccaccccacttgtatgtaaaggacagtgagtgttgtataaatagtaaactataagaagcatgaattttcatctttattaatgatcttgaaataaggaagagaatgcttaatatgttaagtagagccaagaatgctactaagaagcattgtctttggaaaaattttgtataatgacttggggcataagttgtgatgaaaaggcaacttggtttttggttccagtcatacttaatgatcagaaagctctaagatgttttctttaaaaatagaattaagtttaattttttgcatggcttacagattgggtcccttgaaggttaaaccatgtgatggtataacctgtgagatcttctagattggcactgttcaatagggctttctgtgatgatggaaatgctcgaaaacctgtgccgtctggtacggtagccaccaggcacattgacttttaggcagttaaaatggggttactacaagggaagaactggatttcaaattttatttaattttaattagcttaaatttaaatagccctatgtgtctagtggctgccatattgaacgatgcagttctgggtgatagcgcttggggatccagcatcaaggtattaatggagtaacagtgaggctaaggtgagagtttgtgggctagtgacatgcagttggcaaaaggcaaaacattcctttctgggcttaaaaagtatgtgatctcaagtatgacagtaaaaattcattgttgccctttggaactgttgcttatagattttaggccaaggaatgatcagtgaagcttaaagaatgctttattaagccccttttctgggatcattagctgcatgttaacctattgtccaaaaatagtagttagacagtacctgtaaaacgtttgacttgcaagctatgcatgatctgtactgtgaaattgtgtctagggtcttgtggccaaaaagtaaatgttacaggaaaaaaaaagcctaatgaaatccctgttcacttccagtatcctatccaaacttcattgctgtattagtaaggtgcaaatataagagcaagcatgttttgcagtgttcagactggttttgtttgcccttgaagttggccagcttgtcgttgtatttggtgtgggcatatgtgggcatcatttttcagatgccaaactaaaatgtaggtagtatttttagaatgagatttgacattgttttagtgtctttcttttttaagcaaaaatttcagttatccctgaaagagttgaagatttgaagctttgcacaaaagcactttttttaacagtaaaaaatactgcccatgaaatttaaagacttgaagtttactaaagctacaataattactttttagctaaataaaaggaagcagaaaattcagtttgagatatatttcctataaagaccagattcttactgataatctggtatttattccagtctagattttgattttaagagttcccatccctttatttgaaaacttatgttgtttcaaaattggttagtctgcttttcattgttttccaaatggaatatatacaaaatacatttacttcattttagcagaaatgggttgattttttttttctagaactcatcaatgtgcaagactttccttcttagcttgcctttaaaaatcatttaatttttttttttttgccaagatactaatctttctttagccttaataggaagatagaagttcaaaagttatcggtgcaaaaggagtgatacacaaaagacttcaatttctatcttttctcagaaaagtgatgctgcccaccagtcagcattttgtttccacataagaagtgtcaggtagtcagtctgtcatccctgacttagatagagaagctgttccttgacatttccatcattctcagtaaattgtcacctacaaggtaattcttaccaaaacagaaactattgagaataataagatagtcgagataattcagtagctgttttgaaagtagtagtctatttaaaaagcaacgatgttcagttgctggattttgttcaacatgagacacttatttatttatttatttatttatgagatggagttttgctcttggtgcccaggccagagtgcaatggcatgatctcagctcactgcaacctccgcctcccaggttcaagctattctcctgcctcagcctcctgagtagctgggattataggcatgcgcctccatgcccagctaattttgtattttttaaagtagagacggggtttctccatgttggtcaggctggtctccaacttctgacttcaggcgatccacccgcctcggcctcccaaagtgctgggattacaggcatgggccactgcacccagccaacatgaaacacttctaaaagataagtggaaattcaagccattgatttttctgacacaactgacttactacacacacacacacacacacaccacgatttagctgtaattggagttaaaattcagtaaaaaactgttattagtcatgttttccaatttgtgagttatacaatattggattagatgctaatttcttaactgttgctatgggctgcatacattatgtcaaactaactacctttgggagtgtctatataaacacttgaaacttttcaaatatatgaagaggtaggttctactgtatacattttattggaaagccattaatcattgaagaacttaagcaggtggggcatttaatttcttccaaataccttattttttggatctgctcaagtggttagggcgagtgcaccattattcccgaatccctgcaatttggttcccatttttctgcacaaattttcttgctcagtcgagccaatgactttttttttttttttttttttcaggattcactgcctggggtatcccactatatatatctcacctatgatgtagtggtgcttgaaatactcatctcattagctcgattttattattctaatctaaggttttttatattattcatactatgatatttttagggacaatcagtaatatttggggcagagtactgagggacctcttgaagtctgcaacagcatgcattttctttgtttttgtgggagtgcttccctgtagctgtctttgttctagaacactgctccaaatttatttccatgggatgtagggctagtagcccatgtgaaagtcttctgtaatctccttggggtgtgagttattgggttattctaacaggagttttccaaagggatggcccatttttaattcaacatttgctttttgaaaatccagaagtagacagttggatataatagtggtggaagagcatgggctgtaagcagaaggaaatagagatgacaaatgcctcttaaaggggatctagttgatacctctgttaaatagtgggagaacacagtagctggtaccttacactgtgctttaggaaaatcctatgaggatttcatttacaaatcctcataggattttctgggttgagggacaatgcaactattaagtagagggagagggagagggaaagggagacatgaagcactgggtctatgtgaagggacaggcagatatacccaaagagggagaaaatacttaataaaggaagagtatagctgcaaaacaagacatataggagctgaaggccagatatggcagaaaccagctggagaaagaagcacaggacaactaggacaacttagtcaagcacaatctgtcattccagtacggactaccaagttcaattcaggatgcttcagttgaagacatgtggggtaatgtgctcagctcatgagggtccaaggagtccccattttccctatcaccctatcctatgctcgtggtttggattgttagcacactaggcaatttcagagtccgctctagagttggttgccacgtcagtgcagacagactctagaatcctcttaaccatggaatgcaaggcctgttcctgtggatctatcctgacttgagtatgtcagtactgttgggaaaatgagttcaagaatatttcagtttatatatcctggttgccgtcatatattttttcatttcaccacttgtttgtgtttgcctcactcaacagtcatgggtgtagaagctggtttcagcttggggctgttacaaactccctacataagccatgtagctgcaatccagggttcctcccaccctacggctttagcggtgggttctctggccctcttgataacaaatactccagtctaatggctatattaatgctgctcagaggctattaactcaaatccttgatgtgtttcatttacaattatgtggattatttattttaggagctttttttttttttttttttttttttaagggccaaatagccctacagataaatgagctgctgggctgtgtagaaaatattgtccaaatgttgccaaatattgacttcgtaaaggggatatcaagctgctgtttataaatctgaatgtcttaaaagcattcttgcttgctctctctgttatagatggtgtcttagccagtcctgagttttccaatgaacccaattttaatatatggtatttttgtatgccaaactggtgtcttgtcctttgtatatgtggtaatgttgattttatgactaccgtaaaaacacatttgctatgattaaagttcataaaatgatttcaaataga

SEQ ID NO: 17879 - DNA, 682 bp, Homo sapiens
  ENST00000591306
cgggcgcgccgggaccacccggcgatgctgtcgccgccgccgccgcctctgtagcgagcacccgagcccgccgcggagaaaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtcccaggactctctgctggaatgtcagatctgtttcaattactacagcccccggcgcaggcccaagttgctggactgcaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacaccccggtcttcatcaaacttcccagcaatgggtgctacatgctgcccctgcccatctccaaggagcgtgcgctgctgccc

SEQ ID NO: 17880 - DNA, 549 bp, Homo sapiens
  ENST00000588064
agttgcgcccccggcccgcacacaccccggctcatcttctcccggtccccttgtctcgcgccttctccagccctagaagttgccccagggcccctcccgggattagagagcgctgtgaagggccagatgttgggggtcttttgtgcagacacacgcgcctggggcgcttgctcctggaaggacagcggcaggacaaagccagctggactcgtggggcgctgctcgggaagcggcggtccccaatcccgcctggggtcggggcatggcttggggagcgctgcctgggtctggagagagtagagaaatcgccaaagcagagtgacggtgacttgatgaggctgaagaaagctcagtctcaattgtgtttcctgcctgtcagcctcttgcctcctaaacgtgtaccatttccacttgatgtcatcacgcagaaggggtgaaagagactcggtgacagatacagatcccatctctgaatccctgattccaactggaaatggcctttgctgcctccaacatcttgcagaccatggcatatcccaggggatggcc

SEQ ID NO: 17881 - DNA, 792 bp, Homo sapiens
  ENST00000619552
cccattgtgacgtcatggaaaccggaaaggaagaaggtgttggttttcctgcttcttttcccatggcttcgagagttacactgtgtgatccagcagtctgactccatgattgaaatcacaattgggataaagttggtagagatgcttcttaatttacagtggggttatatcctcataaacccctcataagttaaaaatattgtaagtggaaaatgcatttaatacacctactgacatcatagctcagccttgtctgccttaactgtgcccagaaatgcgcattagcctacaatgggggcaaaatcatgtaacaagaagcctattttgtattaaagcatcaaatatctcatgtagtttattgaatactgtattgaaagtgaaaaacagattggtcgtataggcactcaaagtacggtttctactgaatgtgtattgttttcacaccattgtaaagtcaaaaaatcaaaggtcataggtcaaacagttgtaagtagggaaccgtctgtgcttgttacatgcttagggattttcaatttctaattgactcactgtcattgtaggatttaaagagggagacctcaaatagtgtatctgtgacctgcatctcctttgggtggttcttgatgtccatgatttcttggcctagatcacgtttggctgctaaggcctggactacgttcttcgtggagttgtgagggggctgcttgtgatcgcctaggagtggagaggatgccttatttaccccttgatatactaatgcctgcataaataaaactcattgcaaacatcctg

SEQ ID NO: 17882 - DNA, 457 bp, Homo sapiens
  ENST00000588396
gtctggctgaaaggagcgggcgcgccgggaccacccggcgatgctgtcgccgccgccgccgcctctgtagcgagcacccgagcccgccgcggagaaaggctgaagaaagctcagtctcaattgtgtttcctgcctgtcagcctcttgcctcctaaacgtgtaccatttccacttgatgtcatcacgcagaaggggtgaaagagactcggtgacagatacagtgtggttggcaggtggaccctgctcatcgtagtcactcaaggactcaaactgatggagtcttggtcttgatgtgagcttgcaagatcattgcagcatcgggaaggaaatgctgcagggtcttgctctagcaattatgtgatcctacccagagatcacgtttggctgctaaggcctggactacgttcttcgtggagttgtgagggggctgcttgtgatcgcctaggagtggagagga

SEQ ID NO: 17883 - DNA, 5119 bp, Homo sapiens
  ENST00000255324
gagggccgccgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaa

SEQ ID NO: 17884 - DNA, 1490 bp, Homo sapiens
  ENST00000255326
gcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaacatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagttctgcagagctagtttttgtaagccatgtaatagatccttgccatttctacattcggaagtattcacaaataaaagacgccaaagtactggagaagaaggtgaa

SEQ ID NO: 17885 - DNA, 2134 bp, Homo sapiens
  ENST00000255325
gcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaaggta

SEQ ID NO: 17886 - DNA, 2826 bp, Homo sapiens
  ENST00000418120
gctgacacagaccacagatatcaatgtaacacaaaaaatagaagcagctttgaatctaagtacgacatgaaagcctagctctaaagttttgagacttgatatcttatttaacctggtttgataattgaagacaataccaagaaatgttagaagaaagaaattggaagatgagcgcttttggtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacaggttaaaaataaa

SEQ ID NO: 17887 - DNA, 2203 bp, Homo sapiens
  ENST00000339524
ttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatgaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaa

SEQ ID NO: 17888 - DNA, 646 bp, Homo sapiens
  ENST00000488763
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatc

SEQ ID NO: 17889 - DNA, 3706 bp, Homo sapiens
  ENST00000488300
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaatttagaagtttgatttctctgacttatggttaaaattcagttatgactttgcacctctgttagctttagataacggcaaacatgaacattcagaaacgttggttcagctaatgcctttatcatgcccgtgaagacttcagaactttccaacaaaggggacctaacccatcacacttttaaaaggccttcatagtttttttattttattttattttattttattttattttattttatttatttattttaaagcaggggagaaaaattaggggagatgaaataaaaatatcgtcttta

SEQ ID NO: 17890 - DNA, 826 bp, Homo sapiens
  ENST00000420478
agacaaagccgcccgcccgccagcccgctagctcctcgcgcgagctcctcctccacgggaacctccctcccctcccaggcgccgccgcagccggagcggctcccgggccctgggccgccgccggccagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcacca

SEQ ID NO: 17891 - DNA, 557 bp, Homo sapiens
  ENST00000471906
aacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcag

SEQ ID NO: 17892 - DNA, 633 bp, Homo sapiens
  ENST00000423553
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccga

SEQ ID NO: 17893 - DNA, 3382 bp, Homo sapiens
  ENST00000537663
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 17894 - DNA, 3495 bp, Homo sapiens
  ENST00000544682
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 17895 - DNA, 3274 bp, Homo sapiens
  ENST00000537388
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 17896 - DNA, 1854 bp, Homo sapiens
  ENST00000466994
actcttttttttttttaagacagtctggctctgtagcccaggctggagtgcagtggcgcgatctcggctcactgcaacctccgcctcccgggttcaagcagttctgcctcagcctcccgaagggcgccaccatgcctggctaatttttgcatttttagtagagacagggtttcgccatgttggccaggctggtctcgaactcctgacctcaagctatctgcccgcctcggcctcccagagtgccgagattacaggcgtgagccaccgcgcccggcctacccttgaagaccccgcagccaaggtcctccggccccgctctgcgcggcgctctggtcttggggctccggactctgtcatgccgggcaggggccagtccgatccttgcacccttgcctggcaccgtccctggagccttggcgtcctggcctctcctccccgcgggctggaggtggagtggccgggccggaaccagtgcgcaaagcagatggcgagcgcggaggtcggttcggccccgccgcgcctcaaggcagcagccaccctggggaaggtggatgccggaagaggcgtcgcctgcgggtcacccagaggacacccggcggggaattccgagggtgggagtgaggagagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggcaggggcggcagggcgggtgggtgaggagcagagggtacccggttgcacagtccccaatgcttgcacatgcactcagcatgtcttcagaggacgacctggcagtggattctccagcacctccctagggcaccttggccccaaatgtgaaccccattataccggtggggagactgaggtccagaacaagggacttgagccagtgtccagacagtggcagaggctaaggccattcgatctggggagagctcactggtccccaattcagggtggagttgtggacctgcacaggaggggcagtccagtttgcaggcctgggccgaccctgaagggcctctgctacccaagtggcatagaagcagctacagcccaggggaggtggggacagcatgctgttccctctgggctgtaaaaggcacaggggactctggcctgcggaggccagaaaatgtatcgggaatcccaggaggacggcccgactggggcaaaagctccagcgttctggacaagtgctgagcaatgtgtgacccagacgtacagagaggattagcaggaggtagggactgcaggtagggcctgttatgtccatcattgcatgcgtccataccagggctgcaggccaagccctggaatcccagccctgggtctggcttggggaggagaaccttaaagccctcactgctcttcccctccccccgcccccaagtgtgactccagatggccagggtgtacaccacctttcggccactattgagtgtgccaagggggccgtgagaggccctcacacccttttgttg

SEQ ID NO: 17897 - DNA, 551 bp, Homo sapiens
  ENST00000484435
cccgcgcagagtgggaaccatcgcccggtgcgggcctgaacttccagggccggctactcctcggcagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggcaggggcggcagggcgggtgggtgaggagcagagggtacccggttgcacagt

SEQ ID NO: 17898 - DNA, 3924 bp, Homo sapiens
  ENST00000377939
ggccggctactcctcggcagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgagctgatggagaggctgcagggcatcgtcacgcggccgcaccacctaaggcctattcagagcagcaagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgtaaaaagaa

SEQ ID NO: 17899 - DNA, 1413 bp, Homo sapiens
  ENST00000485539
ttttataaaggcagtttctgccctctccccgcgtcccccacccccctccacggacctacttacccagcctctgagccgcagtgccctcctctgtaaagtgggtatatcagagcgccaagtgcctggattacaggaaagggctgcgtttagctgcgcacccggccacggctgggacaaacacgcgcagtgacacgcggcggctgcggttcccgcgctggccgcggtcgggctctggcgctcctgagcccgcgctcggcccgcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggtgagcgcaggggcctggcgcgcggggccgcgcggcggcgatcgcgagcctgaccacgccctgtccccaggccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgaccccctcccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtca

SEQ ID NO: 17900 - DNA, 3020 bp, Homo sapiens
  ENST00000496676
gagcccgcgctcggcccgcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcagccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcctctctgtgcagcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaaggttccagacagttggctgccgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaaccca

SEQ ID NO: 17901 - DNA, 266 bp, Homo sapiens
  ENST00000463453
gcggccgcaccacctaaggcctattcagagcagcaagattgccagtgaccaccgagctgaattcgcgcgctgtctggagccactgctgctgctggggccacgtcgggtggcagctgctgcaagtggtgctaacactaggaaagatgtcggggtcacccgtccaaaagcccacgctgcaccggtccatcagcaccaaggtgctgctggcggagggcgagaacacgcccttcgcagagcactgccgccactatgaggactcctaccgg

SEQ ID NO: 17902 - DNA, 231 bp, Homo sapiens
  ENST00000496329
ggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccct

SEQ ID NO: 17903 - DNA, 612 bp, Homo sapiens
  ENST00000492476
ccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaaggttccagacagttggctgccgagtgaaccctctgtccctgagctaacccacatactagcagaggaggaagtcagagtcggccactaaccagatgcaaatcccc

SEQ ID NO: 17904 - DNA, 473 bp, Homo sapiens
  ENST00000483336
cagacagttggctgccgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatgga

SEQ ID NO: 17905 - DNA, 528 bp, Homo sapiens
  ENST00000514024
gaacgactcatgttttattcttgttccaccacaggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatccccagcctgctgcagaggcagtgtttagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgattatcag

SEQ ID NO: 17906 - DNA, 470 bp, Homo sapiens
  ENST00000503206
caaacagctttcagcacaataaaaagttcagtttcaaactggagtcgatggaagttgatctctctccttctccgattagaaaatctgagatagcagccggccctgcgagaatctccatgattagtccacctcaagatggacgaatgggcagcgtctcctccctgggccccgagcatcccggcctgacaacgagtcagaggagcatgggaaagcctctcagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgatta

SEQ ID NO: 17907 - DNA, 991 bp, Homo sapiens
  ENST00000514757
tttcaaagctggtgcgttagtggctcctgttgtcaggtcttaatttcacacctttaacacccgcagtggccatgtgctgagtgacagttgcagttgtaagagccagtgatgtaaatggcagtggggtgttgagttcacttggcttcagcgctagggaggagcagggccgtgcgactcacaggacgctatgggaactgctgaattcatgtgaaatgccgtttgcaaacccagtaagaacatttcactgattcagagccttcttacactttcagttgggatgacctggggggaagtcagtttttatgatttaattcaataccttttctccatctatttagtatgagatcatcacaacaaacagctttcagcacaataaaaagttcagtttcaaactggagtcgatggaagttgatctctctccttctccgattagaaaatctgagatagcagccggccctgcgagaatctccatgattagtccacctcaagatggacgaatgggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatccccagcctgctgcagaggcagtgtttagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgatta

SEQ ID NO: 17908 - DNA, 978 bp, Homo sapiens
  ENST00000505693
tttcaaagctggtgcgttagtggctcctgttgtcaggtcttaatttcacacctttaacacccgcagtggccatgtgctgagtgacagttgcagttgtaagagccagtgatgtaaatggcagtggggtgttgagttcacttggcttcagcgctagggaggagcagggccgtgcgactcacaggacgctatgggaactgctgaattcatgtgaaatgccgtttgcaaacccagtaagaacatttcactgattcagagccttcttacactttcagttgggatgacctggggggaagtcagtttttatgatttaattcaataccttttctccatctatttagtatgagatcatcacaacaaacagctttcagcacaataaaaagttcagtttcaaactggagtcgatggaagttgatctctctccttctccgattagaaaatctgagatagcagccggccctgcgagaatctccatgattagtccacctcaagatggacgaatgggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatccccagcctgctgcagaggcagtttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgatta

SEQ ID NO: 17909 - DNA, 368 bp, Homo sapiens
  ENST00000508633
tgggaaatgtgttcctaacagacagtgggagtccgaatctcgtaagccgcaatattggaattttacccattgttttcttgttgcattcttagtctgagatagcagccggccctgcgagaatctccatgattagtccacctcaagatggacgaatgggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatc

SEQ ID NO: 17910 - DNA, 753 bp, Homo sapiens
  ENST00000506730
tgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatgggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagct

SEQ ID NO: 17911 - DNA, 2335 bp, Homo sapiens
  ENST00000382968
agagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcaggatattaaccttttacccaatttgctttgtaattttatatttgacctttgaattttagagacaatatttttatgtactcatatatattgttattatcccttttattttataggttctcatgcttagggagtttttttttcacatacttaaatcatttttttctaactgggtggtttttaaaactttttcttagagcagttttaggttcacagaaaaattgaaaggaaggtacagatttcccatatacaccatgactccacacacgcacagctcccccatcatcctcatcctccaccagagcagtccatgtgttaaaactgatgatcctacttgaatacatcattatcacccaacgtccatggtttacattagggttcactctaggtgtcgaatgttctatgggtttgaacaaatatctagtgacatgtgtccccatcgtagcagcatatggaatagtgccacaccctaaaaatcctctgtgcgccacctgttcatccttcccccacctcccaccaacccttgacagccactgatctttttacggtccctttttcagactctcctggagttggaattgtacagtatgtggcttctcagattgactcctttcacttagcaatacacacttatggttcccccatctcttctcatggtttgctagctcattttttcagtcactgaataatattccattatctggatgtatcatagttcatccattcacctactgaagggcatcttggttgcttccaagttttggcaattatgaattaagctgctatagatgtccatgtgccagggttttgtgtagacatgttttcagctcctttgggtaaatactaaggagtgtgaatgctggatcagatggtgagagggtgtttagttttgaaagaaattgccaaactaccttccaaagtggcagcagcttttcgcattcccactagcaacgaatgagagttcctgttgctccacgtcctcacatttgatgatgtcagtgttctggattttggccagctgataggtatgtagtggtatcttgctgttttattttgcatttcattgataacatatgactaggagcatcttatgctgatttttcatctgcatatcttctttgctgaagtgtctgttaaggtatttggcccattttttaattggattgttttcttattgttgagttttaagagtcctgtgtatattttggatgacatttcttttttgtgtgtcttttttttggatgacatttccttatcagataaatatgtatcttgaaaatata

SEQ ID NO: 17912 - DNA, 1074 bp, Homo sapiens
  ENST00000433731
ggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcagg

SEQ ID NO: 17913 - DNA, 926 bp, Homo sapiens
  ENST00000511620
ggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcagg

SEQ ID NO: 17914 - DNA, 804 bp, Homo sapiens
  ENST00000508428
tgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaaactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaat

SEQ ID NO: 17915 - DNA, 934 bp, Homo sapiens
  ENST00000510715
ctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcatcgcccctttcctgtgtctgacagcgagtcaccaacagcacgcctttacagctgcgtgaggagagccccgtggatcccgcacaggggtacccgtgtccgcttgcgccgtcggaccttgtggactcgattgctctgcaccagggttgatttcctccattccttacgccctctgccatgatgacgtcagacgcagcaaaggccttcagtcacgctaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtg

SEQ ID NO: 17916 - DNA, 522 bp, Homo sapiens
  ENST00000512552
cgtggatcccgcacaggggtacccgtgtccgcttgcgccgtcggaccttgtggactcgattgctctgcaccagggttgatttcctccattccttacgccctctgccatgatgacgtcagacgcagcaaaggccttcagtcacgctaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaaggtaaggcgccccaccccccgtgagtgcgcagtcgaggcacccactgccatgtgcattggtcgtctggctctccaagatcaagaatgaaagatgactgcagatgcagagggaagagctcgttcatttaccagaaactttcatcagagcaaaaatgctgtgggaaaaccgaagggaagaagggagaca

SEQ ID NO: 17917 - DNA, 1019 bp, Homo sapiens
  ENST00000333673
ggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccagggaaacaccatccaggacgcacctcaccccctcaccctgctccatcccagcaggaccctcattcacaccaagtccccttggggccagaagttgcttgagttcataaaacatgtctgttatcacagacatcagagccacaggccgtgcgctccagggtggttttgccaagtgctgcagaggccaggtgctgtctcaggagagaagacccagcagacccggccagcccctccagccacctgtctgctctgcctctcgtgcctctcaggcttccggcatgggccgtggaggtcacaggctctgcccagtgacctcgtggccccactgtttgtcagttacactgtggaggtgagcatcacaaacgcagggtggagttttcccgcagctgtgtgacgtgaggtggtattgtaacatttatgctctaatatcaacgtaacataaatattggcatttgttacaatatgttaacacatcatggatttattgttatttttaaatgaattaataaatacttttagatttgt

SEQ ID NO: 17918 - DNA, 631 bp, Homo sapiens
  ENST00000454487
cgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccaggtgagctgtgaggggtgtggcttggttccgtgatgagccaggtgcactatcccgagaccatggagctatgaggggtgtgcttggttctgtgatgagccaggtgcactatcccgagaccatggagctgtgaggggtgtgcttggttctgtgatgagccaggtgcactatcccgagaccatggagctgtgggagttgtgcttggttctgtgatgagccaggtgcactatcctgagaccgtggagctgtggggggtgtgcttggttccgtgatgagccaggtgcgctatcccgagaccgtggagc

SEQ ID NO: 17919 - DNA, 488 bp, Homo sapiens
  ENST00000505730
aggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcatgcgcagtggctcacacctgtaatcccagcactttgggaggctgaggcaggcggatcatgaggtcaggagatcgagaccatcctggctaacatggtgatttgcagatcaaaatcaagtctttggcatctggaaattatagacaggagttttaatattgtggatatcaagcctgacaatatggaagagctaacaggtgatttcagccgcagaattccatctgaacagctataacacatctgtatctagcagc

SEQ ID NO: 17920 - DNA, 8141 bp, Homo sapiens
  ENST00000332468
caccgagactgtgtggacccctggctgatgctccagcagacctgcccactgtgcaaattcaacgtcctgggtgagcaccaggggtggggtccctcggcctactctgcctgctcctcacctgatgcctctctccctgttcttcttcccctcccctgcagggaaccgctactccgatgattagctgcccagctggactctgcacatggggatggacccttcctgcctgcaccccggtcctcagcctgggctcccaggacaggacaggatgggacagcaggatagacaggacagcaagcccaatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagctgtgaggtccttcccctggacttgagcacaggccttctggctcagggtgctgagggatggtgctcccctgtgaggggggtgcccggggcaccccagcctccctcaggaactcccaggcccctcagaagcaggaagttgggctgaccaaagctgtggtagctcagctatatacatggcccctcttgacccttctctgtgaactgaggtgctctacctgacggcctcttcaccaagggaaaatgcttcaggcatttgggagcgtgcgccctgagaaggcctcagcaagtttttggagattgtccttcacagaaacggggtcccattatattgtccaggctggtctcaaactcctgggctcgagtgatctgcccgcctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggactgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaaaagacttagcaaataagcatgagaggagagtgaatctctgacaaggcccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaaaggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaacaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagcccataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 17921 - DNA, 468 bp, Homo sapiens
  ENST00000631046
caccgagactgtgtggacccctggctgatgctccagcagacctgcccactgtgcaaattcaacgtcctggggaaccgctactccgatgattagctgcccagctggactctgcacatggggatggacccttcctgcctgcaccccgatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagc

SEQ ID NO: 17922 - DNA, 534 bp, Homo sapiens
  ENST00000630264
caccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccaatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagc

SEQ ID NO: 17923 - DNA, 361 bp, Homo sapiens
  ENST00000421022
gactgtgtggacccctggctgatgctccagcagacctgcccactgtgcaaattcaacgtcctggatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttg

SEQ ID NO: 17924 - DNA, 1992 bp, Homo sapiens
  ENST00000382363
ggcctcgctccctccgatcccccccgcgcccgggacccctggccccactgttgggccagctcgccgggtccggccatgggccccgccgctcgccccgcgctgagatcgccgccgccgcctccgccgccgcctccgtctccgctgctgctgctgctgcccctgctgccgctgtggctgggcctggcggggcccggggccgcggcggacggcagcgagccggcggccggggcggggcggggcggagcccgcgccgtgcgggtggacgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaatccttggctgcggctttgtgttgctgaccgggatactcgaagccacaggatcaatgtggtgcctcatccaggggcatccttttttttttttttttttttttttaaagagttggagtagggaaggtttaatagtaaaataaacgtggctatattttaacataagatg

SEQ ID NO: 17925 - DNA, 1651 bp, Homo sapiens
  ENST00000215798
cgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctgggtgagcaccaggggtggggtccctcggcctactctgcctgctcctcacctgatgcctctctccctgttcttcttcccctcccctgcagggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaa

SEQ ID NO: 17926 - DNA, 896 bp, Homo sapiens
  ENST00000463319
gtctcaaaaaaaaaaaaaagaaagactgtcctgtcccaggctgaaaaatgggtgaggggatgggaaggaggtgccagagcctggagcttggagcaaggaagtggctctgtgggcagagaggactggccccagcaaggaggaagatggacttgcaggcttccctggcctggctggtgtgaaaattggaaaaaccaatagagggaaaaggcctggggcaaagtgtaaggccagcaggggcgacagtcgtaggtatccttttcctgcagagctggggtgggtgggtctgggcctcccttcccaagagtccttccatctggccccggtgacttcccctcccaggaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagct

SEQ ID NO: 17927 - DNA, 555 bp, Homo sapiens
  ENST00000473077
attccggcttcccaaaccagagagccagatgctctgggaactctggccttggcatccactgtgatgaccccggctccctcccccaccacaccctacctccctctgctcatggccccttgccacacagatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggt

SEQ ID NO: 17928 - DNA, 535 bp, Homo sapiens
  ENST00000431544
acacagtgaggaaatgacagagctggagtttccgtctgttccacattgctgcatttgttctgcctgacttggaccctggaaaacctggccctcttcaatttctgacaaaagagacggagtttcactcttgtcgcccaggctggattccaatggcgcgatctcggctcgccgcaacctccgcctcccgggttcaagcgattctcctgcctcagcctcctgagtagctggaattacagatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgct

SEQ ID NO: 17929 - DNA, 555 bp, Homo sapiens
  ENST00000619645
gagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaaaggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgact

SEQ ID NO: 17930 - DNA, 11325 bp, Homo sapiens
  ENST00000521654
atgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgaggagatgtgtgtcagataatgtgagagagatgaattgacttttggattgcctcattttaaaacttgagggatttaaatcaaatacccaagccaaattggtgatacttttcgcatttttagtaacactatccacttttgtgtatgttgcttgacagaggaacttaattatgccattgtgaaaagtaggaaagaatatgttggcaattataaatgcccacagcaattcccagaaaaatacattagattatgtacgatttagtgatttggtgggataattataaatcgtggaataatttatatatgtggagtaagaagagaggggtcaaaccttttggtacaagcaacatcttgttgccaccaccttgattttctcataggtgctattgtgtcctaagagtagaacagacaagaaaacaaagataattaaacacaagtcaggttacaacatgatatctttaattgtactttctctgctgtggtatcaagattcagtggtgcttgtcagaaaataccttgttctgtgactctgactatctcttgagtcccaaggctccaattgagcctttatctttcaaccttaccacccaagtatatgaccaactgttctcctaaaatacctatgaaccactgtaatcatttccagtccctgatgcccctcttcaacctcatttttctccatacctctgctattctaactattcctcttcactgaaggagaagaggagagacaggaggggcctaaaaactcactctggtatgtgggaaacattagaattccttcctgacctttgtcaaatgagggcacatctgccaagacatcagtccagcttctcccttgttaaatgaaattgtttttaacattacacttttatactggctgttacattagaattacaaaaaagttagtggcctctataaccttaattggcatactttactacaaaaataagaaaatgtatgccaaaaaacgtttttagattttaattttataagcaacctgcacataagccttaatgtgagtcttcacattggattatatttttattctcccatatttgtggctgaaatctctcccaactattgagagtgatctttcccatggtctgctttattgttttgtgttaatatctattataaatatagccttaaaattttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatgatactgtccccctaatatggaaaataagttacaaaattcttttttttttttttttttttttgagacagaggttctctcaatgttgcccaggctggtctcaaactcttgggctcaagcgatcctccctcctctgcctctggagtagctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagataaaaaatactttttttcagttctgtgctatattctgtcactctattccattattaatactaaatgactttccttgtgaaatgatacccacatactacaacatcaagctcctttttctcttaaatttcctaattatcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtatataagattcaattatggattcatgctctgtgaacattgttagatttttaataatctaaagtaggtcacattgaatgtaactgatattaaccctattctagagaaaacatttgtcatttgcaagtgtttgacttttttattgatatgatttagatatgccacactcaatatatttagtatagattcagtacataacaggaaagaaaaagggagagacagacttgagtgttaaaggaccccagaaattgctgaaatgtccttttagattcttgtggctggcaagctatgctgtcattggttctctgcgaatctgtgatgtgttcacttcgccatgccccagcttgggaaatattcttagtaatccaatcaaatccttaaaaacagcatttttgtgaatgtattacttcttcaatatccccatatatttgtattgtttcaagccactagtatctaaatttttgatataaatatctaaattctttcattttatagaaaattagcatgctttatgtttctttataatgaaaagtctagataaagtatcataatttcattatcagctgacaagaaacccttctaagacccatttttttaagtgtcatatggcaactcctcaatagcttacttttattatttgatcattttcatcacaattgcaatcctctagagggtattttaaaaagtagaccaaccttatgtttcacgtgaaacatagaataataattagtttgtatatatataaaaccatttaccttgacaaggacaatctgttacagatttttaatatgaaaattgacaattttgttgcttttagaagcaattaacatagtaattagtaaattctgagagatgacagaaatgattttctgtagaaggaacacaacagtgatgttaaaatgttaacaaagaaccagttgttttgattctattttaaacaaaattgtaaggcaattttatgaaacaaacatttatatcaatgtatatctatttcaaaactgtgggacaattattcattcttttcccaaatagagtaaaatattaaagagaaaaaaattcgagtgtttatctgttattactgtatattcagaaattacagttctaaggaattattgtcatcctctaagtatcagaatgtattccattttaattatattctccttaacaatagaaaattagaagaaatttcttgatcataagatgaatagtaatttgtaccagatcttgtccatcatttcattagattgcatatttttagttttctataaaatttgcagccattttccaaataaagtaagttataatatttttcaagtttaaaatggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaa

SEQ ID NO: 17931 - DNA, 274 bp, Homo sapiens
  ENST00000519971
catgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccagacggagtctcactctgtcaccaggctggagtgcagtggcatgatctcggctcacggaaacctccacatcccaggttcaagcgattctcctgcctca

SEQ ID NO: 17932 - DNA, 10660 bp, Homo sapiens
  ENST00000519565
atgtgcccctcatggtgctgatgtgccgggtgtgcctggaagacaagcccatcaagcccctgccttgctgcaagaaggccgtgtgcgaggagtgcctcaaagtctacctgagcgcccaggctggagtgcagtggcatgatctcggctcacggaaacctccacatcccaggttcaagcgattctcctgcctcagccttccgagtagttgggactacaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgaggagatgtgtgtcagataatgtgagagagatgaattgacttttggattgcctcattttaaaacttgagggatttaaatcaaatacccaagccaaattggtgatacttttcgcatttttagtaacactatccacttttgtgtatgttgcttgacagaggaacttaattatgccattgtgaaaagtaggaaagaatatgttggcaattataaatgcccacagcaattcccagaaaaatacattagattatgtacgatttagtgatttggtgggataattataaatcgtggaataatttatatatgtggagtaagaagagaggggtcaaaccttttggtacaagcaacatcttgttgccaccaccttgattttctcataggtgctattgtgtcctaagagtagaacagacaagaaaacaaagataattaaacacaagtcaggttacaacatgatatctttaattgtactttctctgctgtggtatcaagattcagtggtgcttgtcagaaaataccttgttctgtgactctgactatctcttgagtcccaaggctccaattgagcctttatctttcaaccttaccacccaagtatatgaccaactgttctcctaaaatacctatgaaccactgtaatcatttccagtccctgatgcccctcttcaacctcatttttctccatacctctgctattctaactattcctcttcactgaaggagaagaggagagacaggaggggcctaaaaactcactctggtatgtgggaaacattagaattccttcctgacctttgtcaaatgagggcacatctgccaagacatcagtccagcttctcccttgttaaatgaaattgtttttaacattacacttttatactggctgttacattagaattacaaaaaagttagtggcctctataaccttaattggcatactttactacaaaaataagaaaatgtatgccaaaaaacgtttttagattttaattttataagcaacctgcacataagccttaatgtgagtcttcacattggattatatttttattctcccatatttgtggctgaaatctctcccaactattgagagtgatctttcccatggtctgctttattgttttgtgttaatatctattataaatatagccttaaaattttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatgatactgtccccctaatatggaaaataagttacaaaattcttttttttttttttttttttttgagacagaggttctctcaatgttgcccaggctggtctcaaactcttgggctcaagcgatcctccctcctctgcctctggagtagctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagataaaaaatactttttttcagttctgtgctatattctgtcactctattccattattaatactaaatgactttccttgtgaaatgatacccacatactacaacatcaagctcctttttctcttaaatttcctaattatcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtatataagattcaattatggattcatgctctgtgaacattgttagatttttaataatctaaagtaggtcacattgaatgtaactgatattaaccctattctagagaaaacatttgtcatttgcaagtgtttgacttttttattgatatgatttagatatgccacactcaatatatttagtatagattcagtacataacaggaaagaaaaagggagagacagacttgagtgttaaaggaccccagaaattgctgaaatgtccttttagattcttgtggctggcaagctatgctgtcattggttctctgcgaatctgtgatgtgttcacttcgccatgccccagcttgggaaatattcttagtaatccaatcaaatccttaaaaacagcatttttgtgaatgtattacttcttcaatatccccatatatttgtattgtttcaagccactagtatctaaatttttgatataaatatctaaattctttcattttatagaaaattagcatgctttatgtttctttataatgaaaagtctagataaagtatcataatttcattatcagctgacaagaaacccttctaagacccatttttttaagtgtcatatggcaactcctcaatagcttacttttattatttgatcattttcatcacaattgcaatcctctagagggtattttaaaaagtagaccaaccttatgtttcacgtgaaacatagaataataattagtttgtatatatataaaaccatttaccttgacaaggacaatctgttacagatttttaatatgaaaattgacaattttgttgcttttagaagcaattaacatagtaattagtaaattctgagagatgacagaaatgattttctgtagaaggaacacaacagtgatgttaaaatgttaacaaagaaccagttgttttgattctattttaaacaaaattgtaaggcaattttatgaaacaaacatttatatcaatgtatatctatttcaaaactgtgggacaattattcattcttttcccaaatagagtaaaatattaaagagaaaaaaattcgagtgtttatctgttattactgtatattcagaaattacagttctaaggaattattgtcatcctctaagtatcagaatgtattccattttaattatattctccttaacaatagaaaattagaagaaatttcttgatcataagatgaatagtaatttgtaccagatcttgtccatcatttcattagattgcatatttttagttttctataaaatttgcagccattttccaaataaagtaagttataatatttttcaagtttaaaatggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaa

SEQ ID NO: 17933 - DNA, 545 bp, Homo sapiens
  ENST00000454842
tatattgtacaaaaagcacaagtcttccaatccaagaaggagaagacacttaattacatgttttgaggaagcgaaaggctgccactcaaacttaggtctagagattacagccaaactcagcctcatctacttgtaaggaaatcaagaggaatttggcttaggaaagctatgatttgatttgatttactgttaagtttttttttgtttgtttgtttgttttgagacggagtctcactctgtcaccaggctggagtgcagtggcatgatctcggctcacggaaacctccacatcccaggttcaagcgattctcctgcctcagccttccgagtagttgggactacaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatatt

SEQ ID NO: 17934 - DNA, 450 bp, Homo sapiens
  ENST00000519799
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtctcctgcaaatgataagaggcttgaggatacttcccaggaactcctgcctttttggaggtgactctgtcagttaaagtgtgaatgaagagtggagcataaaagtccattgccagcacttgagtaaagataaagagtaggagaatcaaagctgttgtataattagttctcttctcatccacacccataaaccagttcaagaaagggatgaag

SEQ ID NO: 17935 - DNA, 1771 bp, Homo sapiens
  ENST00000368414
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggc

SEQ ID NO: 17936 - DNA, 1784 bp, Homo sapiens
  ENST00000359704
agtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtccattgccagcacttgagtaaagataaagagtaggagaatcaaagctgttgtataattagttctcttctcatccacacccataaaccagttcaagaaagggatgaaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcgttgaggaaattaagacttactggaacctcataagtggtagaaccaggaatcaaacccaacatttggctccacagcctgtgttgttaagtgatatgctatactgcctgaaacaagtgtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaata

SEQ ID NO: 17937 - DNA, 484 bp, Homo sapiens
  ENST00000431104
ttaaccctgtaggtttccttctctttgtttcaagcttaattaggtagtaaaaatgttgtgtttaatacttttatgtgtgtgtagctggtggagagattttccttatcagctcaattccccatattgaactgaaatcaccaaattactttcctatgccaccagcaacgtgtccattgccagcacttgagtaaagataaagagtaggagaatcaaagctgttgtataattagttctcttctcatccacacccataaaccagttcaagaaagggatgaaggtaaagtacatagatgaagaagccacatttatttgtgctgcaggagcccttgtaatctcttcaaaacacctcctgtgaagccctctcacagacatagagcctggaagagtagattttttcactttccttgagtataagtgattttctttcagatggtgccatctctttctagaaagaatgtaagaaggcagaaaaaaaaaagaaaaa

SEQ ID NO: 17938 - DNA, 672 bp, Homo sapiens
  ENST00000432158
agactccatcaagtataagtacttcttggaacttggccgtattgattccagcaccaagccatgtcctcagtgcaagcactttacaaccttcaagaaaaaaggacatattcccaccccttccagatcagaaagcaaatacaaacaaaatggcaggatgaagtggtttcaaaggctgtttggagtcatctccatttaaggtaaggagagcactgacatggataccccagccaaccaatcgtgagattcatggccacagtatggcaccctgtactgagactaagatctttgttctttgtgatgaacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtg

SEQ ID NO: 17939 - DNA, 592 bp, Homo sapiens
  ENST00000368415
attacagcaaaatggcaggatgaagtggtttcaaaggctgtttggagtcatctccatttaagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcat

SEQ ID NO: 17940 - DNA, 5145 bp, Homo sapiens
  ENST00000560949
atgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcgttgaggaaattaagacttactggaacctcataagtggtagaaccaggaatcaaacccaacatttggctccacagcctgtgttgttaagtgatatgctatactgcctgaaacaagtgtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgagg

SEQ ID NO: 17941 - DNA, 3099 bp, Homo sapiens
  ENST00000355387
tgcgtgcgtgtgtgtgtgcgcgcgtgtgtgtgtctccgagtccctgggagagtggaggctcattcactgattagatccagcgctgagaggcagcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17942 - DNA, 3009 bp, Homo sapiens
  ENST00000361799
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17943 - DNA, 452 bp, Homo sapiens
  ENST00000487332
cctgttgtaataagcagaggagtgttgtgtgtgcattttaattgccagcagagccgtagtttggtgggcgccctgagctcggctccgggaaagagccctttgcagctttctttgtggcagtcatttgcaaaggggtttggctctcagctacggcggaggcagagggggcagcagcaccgcttccttctatgccgatcccgggcgcaggatgggagaaggaaatactctctttgcactgcattaagccaggaggattcatctaccgtttaactgatgtttctctgtttgagggaataccaaagatactccaggtcttaggagggaatgattccccagtaatattccctgccctgacccaaagtgctggttggcctccctcccagggaagactgcttcttgcgtaacgccggccacagaaagagactccgatggacttacaccgggcagccttc

SEQ ID NO: 17944 - DNA, 594 bp, Homo sapiens
  ENST00000470498
agcccagaggatcggaatgacagatcaagaagaattttctgcgaaagaaccttcttacaccttttccaagaaaagatcctggattgggactacatgttgagcctggagaaatgataggctgtagtatgaatcagaacacctggtagatgctaagtaaacagaaggaatttatcatcttccagccttacccaatggattggacttttctgttatcttaatcacactactttagttttagtgtttaaaaaaattattattttttgtctggtaccaatcatctaaaagggtttagtgttcattgcatattgaataccttagtggtggcgattataatctagtttttactttaagttttcatcatcttaccactcttcagcattgcacagaacagcatctgtaagactatgtatgctatcccaaaggcgtagaggtttgaggaaagaaaggaagaacttatttatgccttgaggtttcatgatgatgaaggtagggagggagttttccaagaatttgtgaaatcacctttctcaaatatagacttattttattacttggggtactattaataaaaaatcgtttataacttaacaaaaa

SEQ ID NO: 17945 - DNA, 840 bp, Homo sapiens
  ENST00000496262
ggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccaggtgaggaggggtggtgagtggccatgagaagcaagctcacctgggggagggcttcaagagcctgcccggtgctaactcctcctctcctctgtaggccacaggagaggcctgaactgggtttggttccccctgtgtcccgtgcccctaagtgaactcaggaggcatacgtgtcagggaataggccttaaatagatggattttagggagagatgccaaggtcacatgggctccatgggctctgagcacctctgaatcattctatccatcaggaagtatcctatggggtttggtttcataagagacccagatacatagcccagaatcacctgaagatttcagacttcaaaagcatgataccggccgggtgcagtggctcatgcctgtaatctcagcactttgggaggccgaggcaggcagatcacgaggtcaagagatcaagaccatcctggccaacatggtgagaccccatctctgctgaaaatacaaaaattagctgggcatggtagcgtgtgcctgtagtcccagctacttgggaggctgaggcaggagaatcgcttgaacccagaagatggaggttgcagtgagccaagattgcaccacggcactccagcctggcgacagagtgagactccatctcaaaaaaaaaaaaaaaaaaaaaa

SEQ ID NO: 17946 - DNA, 361 bp, Homo sapiens
  ENST00000453863
ggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggt

SEQ ID NO: 17947 - DNA, 1203 bp, Homo sapiens
  ENST00000335497
cgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatg

SEQ ID NO: 17948 - DNA, 1200 bp, Homo sapiens
  ENST00000440132
cgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctg

SEQ ID NO: 17949 - DNA, 2734 bp, Homo sapiens
  ENST00000474064
agggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaagtagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17950 - DNA, 720 bp, Homo sapiens
  ENST00000471494
acatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaagtagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaa

SEQ ID NO: 17951 - DNA, 860 bp, Homo sapiens
  ENST00000488865
ccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaagtagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatca

SEQ ID NO: 17952 - DNA, 590 bp, Homo sapiens
  ENST00000497469
gcggagcagctttggtcgggggtccggtgctggggcgggggccaggactgcaggccgcgcctgacgctctcttttcttttcttgcatctgcccgcgatcttctcccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaa

SEQ ID NO: 17953 - DNA, 916 bp, Homo sapiens
  ENST00000475378
ggtccggtgctggggcgggggccaggactgcaggccgcgcctgacgctctcttttcttttcttgcatctgcccgcgatcttctcccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagca

SEQ ID NO: 17954 - DNA, 1951 bp, Homo sapiens
  ENST00000484745
gaatgaggaacgagctacacaattctactcgggagctcagctttgaatttgcaaactgctgggacctcactatacaaacctgcagggcgctgagaatgtttttcttccagtttttaatcagtgcccagtagtgtgaatacagcccctctgctgagacttgacaatacagtgagatctggagttcccacggcaacaggaactaactcatcccagggctctttgagttatcagtcggcccacatttcacaaagctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17955 - DNA, 810 bp, Homo sapiens
  ENST00000474394
ggtgaccttttcaggaggaattagattgcctgccaagaccggttagagggagtgataacgccagctgaagaagctgcccagcagacttcagagagaaggaggcagaggcaggatgagcaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatg

SEQ ID NO: 17956 - DNA, 3835 bp, Homo sapiens
  ENST00000480686
cagggagaggtggattgcaggctgtgcctggcatctttccttcccgatgctgcttgcctttgggattggtggtgtctttgtgagaccagagactggtggggtagaagggagaaggatcaagactcagtgtttttcagggcttgaaaaatggagaacattccagatggagtgaatagcatgagcaggggtcttaagagcagcatatacaggctatgtttgtggtttggtgagcagcctgtgtgtgcacatgcttggggtttacagagtgaattagtagagagcaagagtaaagacataaatggacccagatcttcatggatctggctgaggagcctgggcttggttgtgcatgcagtggggagccatcaatggttttggagcaggaggaaaggtggtcagaactcagtggtaagcagaatgaaggaacagataagaggcctgaggactccctacaagacataccctaatgagagtataaggacctgagaggaaagagtggacaagcagaaatgtctgaaatcatcaggcagatactaagctgcttcctcacttctttaaggatttccttgctgatcccagtagccacagagtctcacattcttttgtccctggcagggctgtgctggctagtgaggtgtggtctgagacccactaggaggaagtggggagctggggggaacagctctatagcacttgaccctaggctatcaggaagggtggtcctggatgtcagagagatcgcctggcaggtgagcaggcctggtgtagccccagcagctcgcccctccctctgagctgagagtccgtctgtggctgtgccagatgcacctcaggggtcagccacttgcgtggcccatggcctggcctccgctcagcctggttgccttcatggactgctttgagaagtaggtgtgcatgcctgtcctccctcgtctgtcccttcttaatccctttataactgcacttgtccaggaatctgggctgagtgaggtggagatgaataattaatgtcaggcgcttcagacaccaaatatttgaacagctgcctggtgtttttgctggcaaggacctagcggccaaaatcaggatgttggccgggggtcccactctgtggctctgattggccttagccagcctgttctctcctctgatggacttgtcaggctggataatggggcataggggaggccccactcttttcctgtgaaattcctagacctgaatttttctgtcctcttactgttcttcctagacctggaagataggtggacagcaggcctgggctgagtgtccccgaggacgtgacataatatatgaatgggctagtttatgagcagagaccacttggagcagcatgcagtagcagagaaagatgaggtttgcagagtgaagggcctgaaatgtcagggtcaggggcactgaagtatctggctctatacatcccaggcccaggtttccctctgggccttatcaggtccaaagcctaacccctacctggaggcaacaggaggggcacccttggcctcgtcttgtccccaggccctcctcacaccctgcttcccacaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17957 - DNA, 3303 bp, Homo sapiens
  ENST00000474956
ttgtaaggtgtaaataagataattatcaatccctcagtacaatctctggcatttagtaagtgcttaataaattttagctattttatttgtattatcattattattccctaaggccagtctcctataccatcttttctacttttccaggaagcattcttctccatctgtgagctcccctggatcctgttcatttgttttaggagggtgggaaggttccttgagagagtcctagctattccctgttcagcagtgcagcccaaggagtcctggaaatgcaggagggaccttcaggtgcagggcttggcccacacacaggactaccagggcatctgatatatctaggaagtaacaaggagccctggaggcaggccagggctgtggcaaagagacctagatcatgtgggacacgcctagtccctgcatctgtccccctctccctggagtttggacgggccctttcttcagcaggtgtttgctcacgtcccatgcctgaggtggggctcttggccatagtcagtattggtggagtgagcagcccgccctcagggaacccatactcaggaactttacactgctgtggtggagttcacacggggggctgtgagagccactgtgcagtgctggctcaggggtctggaaaaggcttctgggagggcatgggaacaaaactagatctgaatgatgaggcagagctagtgagtcaggcgagggggtgcagagggatcacagtgcagaggccaaggcagtgaaaaaggtggcgtggatggtgacacataggagtcgagcataaaatgcgtggcaaggtcctcaggggtacggcgggctggggctggaccaaggagtgtagtggagctctctactccaagggggacattggaatgttggaagtcacaccacgagagatttgctttgagaacataaattcctctaggcgctgggagagtggaatagagatgaggggcctggaggcagaaaggctgtctggaaaaagttagtggtggaattggtggaagacatctgagagcctggactcatggtggtgaggagagatgccggagatactaggagagatgacagatttgggtggttgggaagactgcgaaggagtggttgaaaatggttccctggtatctggtgtagaaattcatccgaatgggaatggaggaatagagagggtgaggagtttagttctggaatgtggaatttgcagattcaggttatcagagaaagggggcaggcagggatgcctaggggacatttatgtatttggttctggaattcaagggaggcgtaggctggaggtacagatgagagatgccagcctgctacccaaccatgccttcctttttacagaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 17958 - DNA, 3010 bp, Homo sapiens
  ENST00000372247
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttg

SEQ ID NO: 17959 - DNA, 1970 bp, Homo sapiens
  ENST00000451425
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17960 - DNA, 2206 bp, Homo sapiens
  ENST00000432647
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17961 - DNA, 2206 bp, Homo sapiens
  ENST00000425956
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17962 - DNA, 1970 bp, Homo sapiens
  ENST00000442378
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17963 - DNA, 1970 bp, Homo sapiens
  ENST00000441449
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17964 - DNA, 2206 bp, Homo sapiens
  ENST00000450015
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17965 - DNA, 1970 bp, Homo sapiens
  ENST00000417541
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17966 - DNA, 2206 bp, Homo sapiens
  ENST00000449145
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17967 - DNA, 1961 bp, Homo sapiens
  ENST00000376750
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 17968 - DNA, 2161 bp, Homo sapiens
  ENST00000383611
ggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgagcccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 17969 - DNA, 1970 bp, Homo sapiens; identical to SEQ ID NO: 17959
  ENST00000376751

SEQ ID NO: 17970 - DNA, 2206 bp, Homo sapiens; identical to SEQ ID NO: 17960
  ENST00000244360

SEQ ID NO: 17971 - DNA, 2206 bp, Homo sapiens; identical to SEQ ID NO: 17964
  ENST00000456156

SEQ ID NO: 17972 - DNA, 1970 bp, Homo sapiens; identical to SEQ ID NO: 17963
  ENST00000442063

SEQ ID NO: 17973 - DNA, 1970 bp, Homo sapiens; identical to SEQ ID NO: 17959
  ENST00000457092

SEQ ID NO: 17974 - DNA, 2206 bp, Homo sapiens
  ENST00000420562
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggggggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 17975 - DNA, 5516 bp, Homo sapiens
  ENST00000407977
atatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaattatcagccggaacgagcaaacagacggagttttaaaagataaatacgcatttttttccgccgtagctcccaggccagcattcctgtgggaagcaagtggaaaccctatagcgctctcgcagttaggaaggaggggtggggctgtccctggatttcttctcggtctctgcagagacaatccagagggagacagtggattcactgcccccaatgcttctaaaacggggagacaaaacaaaaaaaaacaaacttcgggttaccatcggggaacaggaccgacgcccagggccaccagccc

SEQ ID NO: 17976 - DNA, 3560 bp, Homo sapiens
  ENST00000583753
tgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 17977 - DNA, 5575 bp, Homo sapiens
  ENST00000584437
ggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaagcatctcatgggaaatcaaagtgctcggcatttccgagctggagaataaaatcaagaatccttaagagagaaaagaaaatggagatggaaatatgaattttaactgggaaaaataattggaaagctaaccttttcaaatactctaattatgaaagttggaaaaggttgtgatgctcaggattatcctgtaatgtgtgaagatacataaattagcacctaatttataggcaaattttggtaaaacacaaaaaattatggtatgtctaagttcatgaaaagtatgtaaatgcagtgggcctagaaacctggccacactgaaatacagtttaatgtggaaacttttctaaatacatattgtagcatctttggacatcaacgtgtggcctgaaatttttattattgttccctcttctcctccattaaaaaaaaaatctccttgtggtatttagtcatttaccattaacacatattatggcttaaaaagggccatcccttccttttctgagctggagttcttcacgctcacctttgatgcatggccttagctgtttactttgccttgttttgttcatgaacattgggtttagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 17978 - DNA, 4367 bp, Homo sapiens
  ENST00000577716
ggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 17979 - DNA, 2198 bp, Homo sapiens
  ENST00000577625
acagcctcatctctgggacctgaatagacaatttatcatttgaagaaaattaagactataactttaagaaattatcttctggtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagc

SEQ ID NO: 17980 - DNA, 2610 bp, Homo sapiens
  ENST00000581868
aggatctgtaaaagcataattgaatttgtttcacccccgtggattccagtgggcccgacagcgcaacagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggtgagttttcagagggaagtgggtgtggtagggagaggagactacagctgaatatttcaggacaggtgaagtcagccaacaaagggttgatggaagctgagaaggatacagcagagatgacaaccaaaatacttaaccatcgggacagcgtatcatgctggctagagtgcaggaacaccccacctctgccaggtgctacccctttagttggcagatcacagggaggtcccagggaggtgctggtgtggctgaggcatcagaaaggcacttggaaggccgggtgtgatggctcatgcctgtaatcccagaactttgggaggcctaggtgggtggatcccttgaggccaggagttcaagaccaacctggccaacatggtgaaaccctatctctactaaaaatacaaaaattagccgggtatggtggcgggcacttataatcccagctactcaggaggctgaggcaggagaatcgcgtgaacctaaga

SEQ ID NO: 17981 - DNA, 324 bp, Homo sapiens
  ENST00000582293
ggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctgggtaagcacactagacctccagaccttgccctgcacttagccctactttgtcctgtggcaactcccaccaaaagcccttagactcctggagctgcgagagatcctggaaaccctctagtccaactt

SEQ ID NO: 17982 - DNA, 497 bp, Homo sapiens
  ENST00000580014
agtcccaggggagggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggttt

SEQ ID NO: 17983 - DNA, 5919 bp, Homo sapiens
  ENST00000487694
cgctggaggagggaggcggaaggacagcgctgcgccaccacccggaggagggagcgcggtagctgcaggcaggggagggagaggaaagaaaaggaaggacggctcccagacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacatt

SEQ ID NO: 17984 - DNA, 3382 bp, Homo sapiens
  ENST00000602589
agacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcgccctgttgctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtgga

SEQ ID NO: 17985 - DNA, 522 bp, Homo sapiens
  ENST00000475034
gactgcgtactgaggagaaggagccggatccgtgagaaatgtagcttggctcagggctacatcaggaagctgctacttcagctgttaaagatggcaaaacaacacctacctcaggtttttcaatgattaatgctattttcataaccaggagggaagaggatgtgagaaattttgtgaaattaacttgtggaaatgttatcatcagagaaagtggagaaaattactaggcttgaacttctcttcgttttgatgctcttcctctctggaccaactctgagcaagctgacccggaccccctggaaaggaaaaccttggaaggggggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagc

SEQ ID NO: 17986 - DNA, 8946 bp, Homo sapiens
  ENST00000461745
ggcgaggggcctcagcgcgcctggcgctggactgagcgctccctttctccgccgcgcccgggctgggctctcacgcccgtctctgctcgcgcccgcagccgcctggtgcactatcctcagaggcggcaccgcgggggtgtctgcagcctcggcctccgcccggcccctccctccctccctccctccctcgctccttccctgcctccctcaccacgtaggagttcggattctccacccgaatcgtcctgatttcccttctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 17987 - DNA, 5437 bp, Homo sapiens
  ENST00000332191
ttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttc

SEQ ID NO: 17988 - DNA, 5393 bp, Homo sapiens
  ENST00000473767
ttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagatatgtagtttagaaggctcagttataatattgcatgtggaaatgatgcaaaagaaaacacaccttgtaacaggaaaatgtattggcataatttactctgtagtccatttattctttctacaggttaattcttttcaagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttc

SEQ ID NO: 17989 - DNA, 1431 bp, Homo sapiens
  ENST00000490991
acaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaa

SEQ ID NO: 17990 - DNA, 642 bp, Homo sapiens
  ENST00000471893
ttcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatgccttactttacattcctgactaccgattggctgagggattgtctaatagaatgccacacaaccagtctcaggatttcagcaccaccagctctcacaacagctcagaaaggagtggcagtctctcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgg

SEQ ID NO: 17991 - DNA, 780 bp, Homo sapiens
  ENST00000469233
tgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataa

SEQ ID NO: 17992 - DNA, 686 bp, Homo sapiens
  ENST00000475334
ggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacagagtaaatgagaggagacatacaaagctgctctgaaggaccatcaggtccggactcatggaagtgat

SEQ ID NO: 17993 - DNA, 9570 bp, Homo sapiens
  ENST00000470802
gctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattca

SEQ ID NO: 17994 - DNA, 805 bp, Homo sapiens
  ENST00000490534
cagtaacaccagtgcagccctgagtcaaagtcagaggcctcggcccactaaaaaacacaagggagggcggatggaccaacaaccagcattgcctcatcgaagggaaggaatgacagatgatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttg

SEQ ID NO: 17995 - DNA, 7662 bp, Homo sapiens
  ENST00000614793
tcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 17996 - DNA, 4569 bp, Homo sapiens
  ENST00000397801
ggagagaaggacgagggaaggaggagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacgggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 17997 - DNA, 4551 bp, Homo sapiens
  ENST00000538940
tcgccaagcgtggttcagccactcccgcttaaacttggcaggagaggagacggaggtctctaggtggtccagaaagccggcctagaagtttgtgtcccgatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 17998 - DNA, 1942 bp, Homo sapiens
  ENST00000527196
gctgcgtgagtccacccgagggcagtgctgaggatcttgacgggggcggggcaagccccccactggggtagctgtgcctgccgggtcgggaatgaccctttcccagttccagggtttcgggcccctcctcccctcacttctctgacccccacagcgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagccc

SEQ ID NO: 17999 - DNA, 3255 bp, Homo sapiens
  ENST00000527245
ctcccggcctcggagcggacggatccgggagggagccaggcggcccatggggaggggcaggggcttagccgctggcgagtgaggaccgggtcgggagaaaggggtcgcacctggagttcagcctcttgggtaggggcgggatacgtggggcgactcgaggagctgccaggactagggagggctgcgggccaagacggggcgggatctggatgacgtttgcctctaagacgccacgaggaggccaggctttgcaaccatctccataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggtagggaggtatatagtacctcactcattgcaagccctctatacgtatctactcagtagatgactgggtgggtggatggatggatgggtggatggatctggggtacagaggtctcagggctgtgtcagggtggaagtgtaatttgggcaggaatatggaggctgacaagatctctcatgcccattagactggctcttgctggagtggtcagcactctacctgagacatttcagatatggctctccttatgcttctctagcttgggaggacttacgggcggacgggttgtgtctcgtttatctgttaggttgattgtctagcacagtgccaggcacatagtaggcattcagtttttgtggagggaacagaggctgcggcctcctgtcattgcaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 18000 - DNA, 2272 bp, Homo sapiens
  ENST00000529658
cggcctcggagcggacggatccgggagggagccaggcggcccatggggaggggcaggggcttagccgctggcgagtgaggaccgggtcgggagaaaggggtcgcacctggagttcagcctcttgggtaggggcgggatacgtggggcgactcgaggagctgccaggactagggagggctgcgggccaagacggggcgggatctggatgacgtttgcctctaagacgccacgaggaggccaggctttgcaaccatctccataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 18001 - DNA, 473 bp, Homo sapiens
  ENST00000531545
ggatccgggagggagccaggcggcccatggggaggggcaggggcttagccgctggcgagtgaggaccgggtcgggagaaaggggtcgcacctggagttcagcctcttgggtaggggcgggatacgtggggcgactcgaggagctgccaggactagggagggctgcgggccaagacggggcgggatctggatgacgtttgcctctaagacgccacgaggaggccaggctttgcaaccatctccataaagaagggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctc

SEQ ID NO: 18002 - DNA, 2139 bp, Homo sapiens
  ENST00000525448
ggatccgggagggagccaggcggcccatggggaggggcaggggcttagccgctggcgagtgaggaccgggtcgggagaaaggggtcgcacctggagttcagcctcttgggtaggggcgggatacgtggggcgactcgaggagctgccaggactagggagggctgcgggccaagacggggcgggatctggatgacgtttgcctctaagacgccacgaggaggccaggctttgcaaccatctccataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgagaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 18003 - DNA, 706 bp, Homo sapiens
  ENST00000528144
acgaggaggccaggctttgcaaccatctccataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgaggccacccatgggccttggccccgccccctactcatggctggcagattcgtggccccacccatctcgaagcccctcggcccaggaacccaggggaagctgctgccctagcaatcctgacccggacgacagatattacaacgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagcccc

SEQ ID NO: 18004 - DNA, 562 bp, Homo sapiens
  ENST00000531888
ataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctca

SEQ ID NO: 18005 - DNA, 572 bp, Homo sapiens
  ENST00000528068
aggcagtaaattgtgcggcggggtctggatggaaaggcggggcccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattcc

SEQ ID NO: 18006 - DNA, 546 bp, Homo sapiens
  ENST00000532472
agtaaattgtgcggcggggtctggatggaaaggcggggcccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccg

SEQ ID NO: 18007 - DNA, 538 bp, Homo sapiens
  ENST00000531119
aattgtgcggcggggtctggatggaaaggcggggcccgctgaaagaaggcgatccgagttctgctacttcctagtaagggacgtctctggagagattctgaggtgtttgagcctcttttgcctacacaccggcaggtaagccatctctgccccagtggggttcagaccccccgggacgggcccttctctcactcattcgccccctcattttccccagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctca

SEQ ID NO: 18008 - DNA, 542 bp, Homo sapiens
  ENST00000530647
gtgcggcggggtctggatggaaaggcggggcccgctgaaagaaggcgatccgagttctgctacttcctagtaagggacgtctctggagagattctgaggtgtttgagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttc

SEQ ID NO: 18009 - DNA, 583 bp, Homo sapiens
  ENST00000526551
gtgcggcggggtctggatggaaaggcggggcccgctgaaagaaggcgatccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacag

SEQ ID NO: 18010 - DNA, 825 bp, Homo sapiens
  ENST00000528820
atggaaaggcggggcccgctgaaagaaggcgatccgagttctgctacttcctagtaagggacgtctctggagagattctgaggtgtttgagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcggg

SEQ ID NO: 18011 - DNA, 1645 bp, Homo sapiens
  ENST00000525482
atggaaaggcggggcccgctgaaagaaggcgatccgagttctgctacttcctagtaagggacgtctctggagagattctgaggtgtttgagcctcttttgcctacacaccggcaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcag

SEQ ID NO: 18012 - DNA, 1046 bp, Homo sapiens
  ENST00000534598
aaaggcggggcccgctgaaagaaggcgatccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggtatgactccaactcctgaaaccccgtttagccctgaccagggtatccccaaagaggatcctcctccctgaccctctggcacctagcccggcacttccttctgacctgtctcatctctggctctttcctgcctgttctccgggtgtccccatcctattctcctcaggagccaagggaggcaaagtgaagcttctggggaaacctgtgcagatgccctctctgaactggccagaagccctgcccccacctcctccttcttgtgaactgagctgcctagaa

SEQ ID NO: 18013 - DNA, 662 bp, Homo sapiens
  ENST00000531075
ccgagttctgctacttcctagtaagggacgtctctggagagattctgaggtgtttgagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccaccca

SEQ ID NO: 18014 - DNA, 920 bp, Homo sapiens
  ENST00000525304
ggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcg

SEQ ID NO: 18015 - DNA, 955 bp, Homo sapiens
  ENST00000524971
agccctgcccccacctcctccttcttgtgaactgagctgcctagaagggccggaggaggagctggagggcaggtagagatgctccctgcttccaggcccacacacctgcggccagaccatgggctgctggggaggaaggggagggggcagcaggaaggccaacgggaaggtatggaagcagctgagccctttccttctctcctgcctctttgatcccagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctcc

SEQ ID NO: 18016 - DNA, 1520 bp, Homo sapiens
  ENST00000543966
ggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatc

SEQ ID NO: 18017 - DNA, 10844 bp, Homo sapiens
  ENST00000335670
ttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 18018 - DNA, 1908 bp, Homo sapiens
  ENST00000309157
ggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcttcaacctgtagctccctgagcaggctgttctggtctcaacttgagcacataaactgggatggagccacagccaagaactttattaatttaagggagttcttctcttttctgctccctgcattgagaaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 18019 - DNA, 1951 bp, Homo sapiens
  ENST00000261523
ccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagggatgaactttttgggattctccaaatactccatcagtgtatcctgtcttcaggtgatgcttttgttcttactggcgtctgttgttcctggaggcagaatggcaagccaccatattcacaaaaggaagataaggaagtacaaactggatacatgaatgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 18020 - DNA, 1701 bp, Homo sapiens
  ENST00000449337
tctcggcgggcgggcagctgcggcagctgctgctgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataa

SEQ ID NO: 18021 - DNA, 485 bp, Homo sapiens
  ENST00000559587
ggagcgtacaagacggtgaactgaatgaacgctgaggtttgactgcttattccttgatgaaccctctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatcta

SEQ ID NO: 18022 - DNA, 749 bp, Homo sapiens
  ENST00000551975
ccccgctgaaccaggaatccgcccgcaagagcgagccgcctgccccggtgcgcagacagagctattccagcaccagcagaggtatctcagtaacgaagaagacacatacatggcaggcatggtacagagcgcttccttgcacagccttgcccatgagctcgtccctggcccggagggacccactctagaggtgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatc

SEQ ID NO: 18023 - DNA, 544 bp, Homo sapiens
  ENST00000560004
aaccacagccacatggctgatgtgctgcttgagggtgctgtgtcaagcagcaaatgggaaactgaagcaatccgtactacccatgctgtccttctgaagaagccaccaggctggaagtcaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttc

SEQ ID NO: 18024 - DNA, 577 bp, Homo sapiens
  ENST00000559343
ctctccagaaagacttcggaggagcttactccactccccggacggtcccagtggcttcgttctccacggcccagaagtgggccgtaccttccgattagagctggggcactctaggaaatgcgggtgaccgtagctccccagaccaaacctgtcttttccaccaacgagctggcgcatttatcgcccccgagtgctccggcaagccagcgggagagtggcgtcgggttgcgagcctcttgccccaccgagtgggggcagaaagtggtcagaggcgcgttccgcggggcgctgcgtgcagaaaagcgaccggcggccacagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagc

SEQ ID NO: 18025 - DNA, 3910 bp, Homo sapiens
  ENST00000558234
agctgctgctgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaaggtaagcctttttaattgttgttgtttctattaatgtttgttagaatatatctttgtgatttgtatgtctccacttatgtcttaaaattcaactccttagaattttgaatgataagaaattacaggatagaagaaatattttggtgttaaattacaattaaagaagttatatatatttttactccttccttcaaaataataggagattacaaaaaggtatttgagcattgcttgtttatcactttcaaccccagagttgaactcatgagcaatctctgtggcaatcttttttaaaaaagagctaactccagacttctacaatgtccctgtcataagcttataaaaagacatctccagtaagtttaattggaatgtcactgagttgagtcttattgttagcacacataatgttaacacatctggcaaaattgtgggaaagctatcaggaagacctgagttccagtcctattgcctccacttgtccatattgttttgaatgtgtcttaatctctttgtcactcagttgcttcatttttaaagtgggtataacacctgatctttctactggttaggactattccaagaatagaaggagaacctgtacataaaaaagtccttacaaacagaaaagtgctatttaactctaaatattatcagtattatttctgctatgactattttattatttctgaccttggtcatggggcaatgtgtacagcacatgcataatgtgcagatgagaaacagagatgtttatcccaataattcaagaccccccaagcccagattacctctgttattcaaatctcaatttattaagatttaaatcctcatgcttatattggaagggcctcgagacagcttacaggataaaacagtgcaaaataaacaggagagaagctatttaaacatgcaggaggcctttgagacagccgattgctacaaccaggcctgaatcagccctaaggctttttgaggctgaggcaaaaaataaaatccacgaatttggttagctttcctttcatgaaattagaaaatacaatgttgtaaaatacaaaatcacctatagacacaaatgactactgagagacttcaaggaaattaaccttataatttccttaattcttcattttactgttagtcatggtaacatttgctaatttgtacatgtacagatgcttcatgttgatcccatcttagcaaagcttcagatttccgcatactacagaaccatctatgccctttacttccaaaatctgccctccctcaaaattagttgactaattaaataaattaagcaaaatgagaggcccggtgtagtggtgtgtacctgtagtcccagctactcagggaagacagctgcaggtttatcacttgagtccaggagttcaaggttacagtgagctatgatcacaccactggactccagcctgggcaatggagtgagaccctctctccaaaaaagtaaataaaaataatgaaaaaacaaaatgaaataatctgtctggtctgtgccatcccaggttataaggtgagagtgatctgcctgtgaccactgtcatcgcattgatttttggagctgatttggctgacgtggccaggtagccattgcttttcaccctcaccctgtcttgtgttctgcctcccaaatctgtgtccctggtagacatgtcatggcctttctcaatagagggtttatagactgcagtgcttgcctgctgggagttccagtgctttttgtgcattgcgtatcacctgggtgtcttcttaaatggacagggttctaggcagcatcccggataccagttcaccatttgtcccttcattctgcccaaaaaactgatggcttcctctgaatctgtcagtaaggcaagtgattatctaggaattgacagaagtgattatctaggaatggagtctggggaaaggacaaggtgggggtaggggctacttcatatgaaataccccaacaatttggaagattaattaacaacatgctattgagtaaaacctaagttgactgagtaccatggcacaaacaatgtgaattttctttttactcttaatatttatcatgacaaaaataaaagcgataagaaaacaaaaggtatctattattccaaagttgccatttttctagattcccttccagatcttgtctgcatacctcctcagtgccaaagtggttttcagttatctgtggctctgttcctctgctctgttgactttatccaatgaaaaccacaaaataaataaaacataattttattaacagattgggcctatgcctagccagggacttgaacaatgtttcatgtttatatttgatacatatactctttgttctccattataatttctctctgctataactaacacttttattcctagttataaaaatagaagtcaaaagacttctatttttgccattttatgttaattatttatcatgttctaaccaggtaaaggtggttctatcatgatcaattgtaaataactttgctgagatagtgtaattaaacataagaaaaatttcacattagacatatcaaatagatatctaatgagagaagaaaggtgatcagtcatcttctgagctaatcattttgtgaacgtattttaaattgcatttttaaattaacaagctgacaccataagaaactagaggacctgtttaattgctgaaataattattttggcacatagttgctaagcattgcacatgaacagcaaaaatggtagaagctttagtagctctttctgtcatttctggctcttcctagttcatcctctccccaacccctttgctgtctgtagagagacagcaggtgccatgcttctgctctgactctggaaccagactgcccgagttgaaatcccagctctgctatttaccagcttgagcacctataccactgctctgtgcctcagttcccccatctgtaaaatgaggactgtaattgtaataacttcatagggttgtcacatgcatttaaggaaagtacctggaagaatgccagatgcatcacaagcacttactaagtgttagctgttgttatcattgtcattactaggcagacttcttggtggcttggtaatgctgctctgtatagtcagatattatttctgggacatctatggatatagtcttgattgttgtgaccatttgcaatgtgttatgtagaatctgccaataaaaaagaatactatgagcactcccttgggaccaagcactatgtaagcactgtaagggatccaaagacatagaagaccacatctttccctcaagcagtttatggtctagttgtagagatgaggcctgtgtagggaaagctaaatagcaatgcaagaactaatatagagtaaggccacaatctatgatatacataagaagcacatataggctgggcacagtggctcacacctgtagccccagcagtttgggaggctgagctgagaggaagatgtgagcacaagagttcaagaccagcctgagcaacacagcaagactctgtctctacaaaaaaattaaaaataaaaaaaactggctaggcatggtggtgtttgcctgaagtcccaactactcggaaggctgaagcaggaggattgcttgagcccaggagttcaaggctcctggtgagctatgatggtgccactgcattccagcctggcaacagagcaagacccctgtctc

SEQ ID NO: 18026 - DNA, 545 bp, Homo sapiens
  ENST00000557822
agcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaaggtaagcctttttaattgttgttgtttctattaatgtttgttagaatatatctttgtgatttgtatgtctccacttatgtcttaaaattcaactccttagaattttgaatgataagaaattacaggatagaagaaatattttggtgttaaattacaattaaagaagttatatatatttttactccttccttcaaaataataggagattacaaaaaggtatttgagcattgcttgtttat

SEQ ID NO: 18027 - DNA, 373 bp, Homo sapiens
  ENST00000559145
aaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatggcaggcatggtacagagcgcttccttgcacagccttgcccatgagctcgtccctggcccggagggacccactctagaggtgggaccaacagaaaattgcaaactcctgagtggaaaccttcacgagggctccgcaaattggtgctctcttctcctggtttcatcccgca

SEQ ID NO: 18028 - DNA, 642 bp, Homo sapiens
  ENST00000561093
attgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatgtaagtaatgcattttttttctgtccaaagttttctgaagagttggaattcgcatatgtctggctgctgtgacccttcaagtatatactaatgtttcagctgtgatccatggtcaacagaggtcattttttttcaatctgtagtggtcggaagtggcacatctccacctgtttgtactgagtgtgtgttgaagagagaggctagagacatattctgatgaattccagtgtttccagccatgaagctttagaaaaatcatgaaatctagccaggaggatcaattacttactgatcacccttatcctagatccttcttagaagagctggtatgtttctaggaaacatcaccttgatttcttttaagctttggtctccttttcctcaccactagttcacaaattaggccgtttcgtactcatgtctgtggagcaga

SEQ ID NO: 18029 - DNA, 514 bp, Homo sapiens
  ENST00000560300
acattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggcttctggaggatctgttgctgattgcactgaaaccagaagttgtacttggccaaggacgagctaaccccaaacagcaagaggtttgagttggctccaaagcacaagcctcacaaatatcccgtgagtctcccacaggcttggggctctctgtttagaattagaacctaatcttcaaatatccctttaccctcttgcctcaaaaaggaaggcagtgaagagcagcagcaaggcatcctggatgagcactggaaggggagaatgctcatgttttagtcgtgggctttccaccagttagctgtgcagctttgggcagatacttgaacttctctgg

SEQ ID NO: 18030 - DNA, 492 bp, Homo sapiens
  ENST00000558904
gcggccgccggctccagggagaccccgctgaaccaggaatccgcccgcaagagcgagccgcctgccccggtgcgcagacagagctattccagcaccagcagagattggcatgcttaaagggctgaccatctgatgtacaggaaatggaaactactctctgaaaagcaagtgatctcccagccgcacccatttaggagaccaggattttattttgatccacaggagactaaatgagttagaggccactcctgtatcaacagagtttgttacttaaatgacagtagggcggttcgcagaaggaacaccaaatagtctgactatctaccaagaagagagtgtttgaacacatgtgcaacctcttgactgtggtgtgtggggcagcatttaataagaaagagctaaatctgcttgatgtgggaatatattcaacacatgttaagtgctaaaatattcaaagtaaataaatgtctatgtactccatattgttaaaga

SEQ ID NO: 18031 - DNA, 577 bp, Homo sapiens
  ENST00000571058
tttaacctcctctgggataccaacccgtgcactcgccagagaccgaggcgagaacgcctcgagaaccgctcagacgcgcccggaactgcgccctggtctccctcccagcgcccgcgcagctcctggcgcgccccttggcgccccgctccgccccgcaccgcgtccggcgtcccgcgccaggcctcgcttgggaccatgggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagca

SEQ ID NO: 18032 - DNA, 630 bp, Homo sapiens
  ENST00000570451
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggtgaggaggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaa

SEQ ID NO: 18033 - DNA, 4340 bp, Homo sapiens
  ENST00000254719
cgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 18034 - DNA, 413 bp, Homo sapiens
  ENST00000571725
aacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaagaagctgaaaaaaaagtcattacttcagacaattctagagaaaggcgaaaagaatcttcaaatcactggccccattaaaggaaaggattgtttgcccttacaccaagtcaaaacataaaagcctcatttgacaccaa

SEQ ID NO: 18035 - DNA, 574 bp, Homo sapiens
  ENST00000573924
actttactgcaggttgttgcaggagaaatgggcaaggctttaggggagaacctcattaacactgaaggctatcaattctaagcaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgaga

SEQ ID NO: 18036 - DNA, 3849 bp, Homo sapiens
  ENST00000574049
ttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaaggtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctctcgcgtgctgttccttttttgaactgcagggtcaaaaatgttcccctcccccacttctgtttcctgagtgggctgtcttcaaaaagtataaatactattgatcgtggtatttaatacactaatgaaacccatggttattgactacataattaatatactgtccaaaagtgaagtttggccgcccagtatgtaaaggtttatattgactcatgtttctttggcaatatgccgcccaaggttttatttatagaggatgaaacaggttgtttggtctccttttcttcttttcacctgttagaaggccactattcccctagtaaactgattgtttccttgtctcaaagggaagattccccccactccccggccaccttttatgtggtttgttaactcttagtcttatatccactccgctggtagagttctggcttttataaacacctttggaagtcatcggttcctcaaaaagagagcatagatgtttaattttcacttattcaaaaaaactggtatttttgttattaagaca

SEQ ID NO: 18037 - DNA, 844 bp, Homo sapiens
  ENST00000573994
cctcaagtgttccacccgccttggcctcccaaagtgctgggatgacaggcatgagcccactgcacctggccctctctggaaattattttaataagtggaaaaagaacattaacctctccccatcttctcagtgtgtctttttattatttctttgctgaaataatgtagaattgtgttttttaggtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgctt

SEQ ID NO: 18038 - DNA, 534 bp, Homo sapiens
  ENST00000549736
gaatttcaggaatattgggagaagtcaccagaaaagaggactgctcccttctgaagctggacttgaacctgagaaaatgtgacctggggctgctggcggccagcttgtccccgttaggtgacaataagcagacagaagagccaagcagctatggaggaaaatcaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtca

SEQ ID NO: 18039 - DNA, 570 bp, Homo sapiens
  ENST00000548197
ccttctgaagctggacttgaacctgagaaaatgtgacctggggctgctggcggccagcttgtccccgttaggtgacaataagcagacagaagagccaagcagctatggaggaaaatcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacag

SEQ ID NO: 18040 - DNA, 531 bp, Homo sapiens
  ENST00000547686
gagagggaggaagaggagggagaggggcgatggagaaggtcatcagttgggtcaaagatggagctactagccaggcctgagacctgagcccctggacaccatgtttctattttctgcttctgtgaaattgcctcttctacatacctcatgcaacgttcgttctacataattcagcaccagcttagattctcactatcaaattgaaccctttcccctttgctatccacacaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggg

SEQ ID NO: 18041 - DNA, 2581 bp, Homo sapiens
  ENST00000543106
gttcctaacccttgatcttggcttgttaaccctttctgagcttccctttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgag

SEQ ID NO: 18042 - DNA, 740 bp, Homo sapiens
  ENST00000551593
tttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcag

SEQ ID NO: 18043 - DNA, 492 bp, Homo sapiens
  ENST00000546426
ggtggctttgccgcggtggtggcagcggtggcagaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgtt

SEQ ID NO: 18044 - DNA, 557 bp, Homo sapiens
  ENST00000551748
ctttgccgcggtggtggcagcggtggcagaggcgacaccgctggaggcggcggagggacgggcccaccaacgctgcagggtctcgctctgtcacccaggctggagtgcaggagcagatcatagttcaccgcaacctccgcctcctgggctccagtgatccttccatcttagcctcctgagtagctgggaccacagcccctggacaccatgtttctattttctgcttctgtgaaattgcctcttctacatacctcatgagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatgggg

SEQ ID NO: 18045 - DNA, 561 bp, Homo sapiens
  ENST00000546703
agaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgccta

SEQ ID NO: 18046 - DNA, 561 bp, Homo sapiens
  ENST00000547840
acttttcactttcagaatggcgtccagtaaatcaatcctgggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcgga

SEQ ID NO: 18047 - DNA, 660 bp, Homo sapiens
  ENST00000547728
ttttctgctctgaattctgagaaactccaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaaca

SEQ ID NO: 18048 - DNA, 538 bp, Homo sapiens
  ENST00000549769
atagttcctttgctctgagagtgagcgacagtattagaaaaagtgtgtggtaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtg

SEQ ID NO: 18049 - DNA, 572 bp, Homo sapiens
  ENST00000552667
aaggcatcttagcgctgtccgtggtgctgaccgccaatcccctggttgccgtttcgaccagctgggatctctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaag

SEQ ID NO: 18050 - DNA, 4679 bp, Homo sapiens
  ENST00000389385
ggcaccgcacacataaatcacgggtgggaggcaggcttggttcccgcttggttccccctgcactgggaagctgccgccccgcttcccttgctcacacagggctttgcagtagtggtggcagccgcggcagaaactggctctggggaagcaattgattcgtctactgccagcagcccggagttgcctacgcggactggaaaggaagggagaagggagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaag

SEQ ID NO: 18051 - DNA, 595 bp, Homo sapiens
  ENST00000550901
agagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcgtgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagaggga

SEQ ID NO: 18052 - DNA, 579 bp, Homo sapiens
  ENST00000551198
cttcatccatgtggaggacagtctgagggagccactgtcccttgtccactgactcactggctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtg

SEQ ID NO: 18053 - DNA, 2961 bp, Homo sapiens
  ENST00000551052
ggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaa

SEQ ID NO: 18054 - DNA, 4452 bp, Homo sapiens
  ENST00000415485
tttctttttgtcttggtcctgcatgatttaggggtagttgatgtgtctgtgtgtctacgtgtgtgcactggtgctttgattttattttgggaagagtaggagagtcaaatgaacaattttctttcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaagaaaa

SEQ ID NO: 18055 - DNA, 548 bp, Homo sapiens
  ENST00000552679
aattttctttcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaaaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaaggtatcatcatcctcttctcccttcttccctgtgcagcacctgca

SEQ ID NO: 18056 - DNA, 562 bp, Homo sapiens
  ENST00000553114
gtctttctacccggcagggaagggaggagttggcaagaatttggctcacccattccccctgcaagcctccagcgtcgcggggcaagaagaggagaagaggaagattgtggtccattcatgttctccagccaatactggccaaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcct

SEQ ID NO: 18057 - DNA, 2429 bp, Homo sapiens
  ENST00000548866
tttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacaacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccc

SEQ ID NO: 18058 - DNA, 547 bp, Homo sapiens
  ENST00000547099
aagcctccagcgtcgcggagcactagacatctactatgactgacaccgtgttcagcaacagttctaaccgttggatgtaccccagtgaccggccccttcaatcaaagttgcagcattctaggtggactttgaaggattggttgtgctttcaagtgtctgttaagagtcttaagccaacaaattgcccttcctctgtagatggtttttccttccactgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgc

SEQ ID NO: 18059 - DNA, 569 bp, Homo sapiens
  ENST00000547222
actgcagaacatgaggatctcagttagtgagctcttgggacctcagttccccacccatcaaatgactcagtctctttctcaagattcttcctgctcagaatctacagtattttgggggtgtctgacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccggg

SEQ ID NO: 18060 - DNA, 5188 bp, Homo sapiens
  ENST00000549913
gctgtgtactattggaccagtccttaagattttggatattcccctttctccatccaaactccactttcttcatgggtaaactgaagccctttctactgagttttcagggtggatgggctgaataaatatgaattgtgcagggctctgtagtaataataaaagtgtgctggctattgtgtcagtgtgctttggatgaggaggaaagataaaaatgggcactcatgaaggtaagagcaacagcgcttggctgccacatcttcaatccctgtctctcctccccaaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtaggacaaaacaggtgcttctttcaggaccaaggacagatcttagccaactggtctacctgagggatggcctgacatcatgtctgtgtttccacccagttgttgcatggtcagcttctgcacttgggtctaggactcctatatctccttcagagttcaccataaatcgttaccaagagggtagcacagggaactctccagcaatgccaagccgcccagaggcttcattgtcatccctggtggcatatctagtgtacaagaggtggaaattaaaattaggaactgagagagactttcaccaccaagatcacactggagcctgggagaatactcggcttgctgagaaggccttcctggaccctgttatttctcctactatccataagcaagtctgatttggactaattaaaagtgaaagatgaatagaaggaaatcagtaaaagaaaattactgctactaaattgctactattgacattatcactattatccaagtattatgattaattattaaaatgattaagagggagaagcaaaacagtaaaaattttaaaaagcaaccatagtaaaaatacattttagttggactagaccactaggactgaccagataaagcccttgcaataatttcaattgatgctaagtgataaaatctggactaaatgacaattccagattgagtgcaggcggtacttctgaaaggaagggtacagcgtttttcataagataacttatcaaggcacttagcacaatgcctgccacctaagaggcattcaacaaatgttttcttcctgacaaggcaagagcaatttctactccttgcagagaatcaccaaattgccaacatatattgcatccctgaggagtccccagttttcaccactaaaatactccttcttcctagttcttctaggctgagaaggctgtatagcataattgttctttataaagcctgtgtatgctcatatgtgtttgtgcatgcaaaaaaaaatgtgaaattgtaaacaggagctagatcaaagaggaggttgggagaaagacttttaatttttaaaacatattcttaggcaatagtcaatgaacccctttgtaggcttcttaagtaccggttttccagacaccagaaaaccagtactcctcataatttgtgttttctttctccaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaagaaaa

SEQ ID NO: 18061 - DNA, 1043 bp, Homo sapiens
  ENST00000552755
gtgcactcctggaggatataagatggtgttttgttcatcttagcacagggattggcacttggtagacacccactggatgcttgttgaatgaacaaatgaatgaatggacaaatgaacagggcctcaagtgaacaaacaaatggcagtgctaatgtgggaacctgggacaagacttggtgatttgtaagcccccaggcagaggtggtaaagcaccttttgttatgtgtattcaagcatccatccagccaaaagtgctggattcaggaaagatggcatctagcccagtgaggtgaggaaactgaggcccagagaggacaggtcacttgagcaacgtcacacaggtggaaggaggattgtagaacctgtgctttttaacaactgctgctgctgtgactcaccagagtctgagtattgagaagaaagaacacactgaaggcagaagagtcagaaagagctgagcgagtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctgg

SEQ ID NO: 18062 - DNA, 568 bp, Homo sapiens
  ENST00000546687
tatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctgtaagtcaatgccttggggctacaggtgggccctgaaggagtcctggagccttggaaaaggagaaccagacagtttcaccaagatcgttgtacactgagacccagagagggcaaggaacctgcccaaggtcacagtgaaacaaatgcctacaactggcaagaatgtgggtctggagtctcaggca

SEQ ID NO: 18063 - DNA, 2535 bp, Homo sapiens
  ENST00000552352
gtccatggccaaagaacagatccatgtgggctgtctttcacatttcctttgaatgaagatttagttaacaaagaacacacaggtcagggacaagtttggtttctaagagtaatttgattttatttcctcgtatgacccaagagaggaaatgagctcaaggggtgctgtccagcactccattagaggtcagccatgtgcagattggttttcttaaataattctctctaccaccccctcccccacctacccaatccttccagaagaagtagaattgccgtggtcactactgaagcagctgacctgctgggtgcagttatgggagaaaaaatgggagaccactaagcagtttctgatcaaataaagattttttaaaagccagaacttcccattatttttgcttagctctttggtaacttctaattcctcatttttgtctcttcttaaaaattatcctcaaaaccacttctgtagatgagaatgaaatgttcgccctctttacaggtcaagaaacagaggcacggtaaagttacgctcatgtttaaagttgctccgctggtgacaacctgaatcagaatccaaatgtcccagcccttaggagtgtttagcccattgtgtttactcacccaggaaatattttgttttgtttggtttgtgttttgttctctctctcttttttaagagacagggtctcgctctattgcccaggctgtagtgcagtggtgtgatcatagctcactgcagcctcgaactctggggctcaagagatccttccacctcagcttcctgagtacctgggactgaaggcatacatcactgtgcccagataatttttgttattttttatagagacaggctctcgctatgttgcccaggccggtctggaactcctgggctcaagtgatcctcccgctttggcctcctaaagtgcagagattacaggcacgagccaccatacgcagcctcacccagaaaatattgattgagtacctactatgtgccagacactgggcctcactggaaaagagccctgtaggcagaagaaacagtttgctcaaaggcccttgggtggaaaggagaagtaaggagtggggtgaggaggatggcataaggttaggttgggatggagcagaaacccaacacacacggtcttaaggccacatgaaggattttgaactctcccctgagtttaaaaggaacccagtacacagttttgagaagtggagtgacaataatcagatttgcatcttcccctttctgtgcatacacccagcctctctctagggattgggggcagcctaaggtgggatagatggtaaaatgccaggcaccaccagccatggccatcaatttgacttatggggagaaagtgagcatgctaagaacacagactctagatgcaacatctggattcaatcccagctgtgtgagctagggcacacttctgcctctctggatctcagtttctgtttctgtaaactgagtggttgtggttctactgcctagggtcatgtggggattaaatatgcctaagttgctcagtcaagtgcctggtaccaagcagatgctctaatgcatattggtcattatcaatgttgatccctttctgatttattcatcaattcaccctgataaagaaggggcctttggggtcaagaggctgttcttattcattaaacgtcatccataatagcatgttgtgtcgcctcccagctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatg

SEQ ID NO: 18064 - DNA, 2349 bp, Homo sapiens
  ENST00000549324
ttttattcctaagcaataaaaaaggggatgccccttcataaactaccagaggggaaggactatgttcatggccatttacctacaaggaaacttgagctctattagaaaaacctcaccagccttcccaatttcaagcagagaattcactgaaaagaggatgacagtgctttgttacacagagtgtttgttggaaggggatcacgggacctggggcagaggatcggcacgggaagacctccttgctcccagaatgccagctcaaggacctctccttggcccataacccctaggactcggcctcttacctcccaatgctgtgggttcagagggctcttacccacatgtcttcctctgttgtattcaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcac

SEQ ID NO: 18065 - DNA, 1656 bp, Homo sapiens
  ENST00000492572
ccgcttcggtcgctcctgaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaa

SEQ ID NO: 18066 - DNA, 1284 bp, Homo sapiens
  ENST00000369817
gcaattcctgacttgtactgccccagtggtgttacagcctcgaacccagtttccagacctaagtcaccgccggcatccagagtcccatgatggaaagggaggctaggttcccctgggaaggaccttgcaccactgctgcaagtgcaccccagaaatcgtcccaagcttttctcaaagggacctgcagccatttataaaagcgacatatcatcctggaaaacagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaccta

SEQ ID NO: 18067 - DNA, 569 bp, Homo sapiens
  ENST00000479366
agtctccgtggagatttctcctcgacctcttccccgcggcaatgtgcgaaccctgggtctccaggaaacggggatacggggcatggctcccagcaaggcctggtccagcctctccgaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttggtgagtcttgaatccgtgtactttcactgctgggaaacgggcggggaaagaagtgcctatggccgctgaaaacaatt

SEQ ID NO: 18068 - DNA, 657 bp, Homo sapiens
  ENST00000436473
ggaggagcgcctctttcccttcggtgtggtgaccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccc

SEQ ID NO: 18069 - DNA, 2278 bp, Homo sapiens
  ENST00000344746
agcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 18070 - DNA, 1519 bp, Homo sapiens
  ENST00000489200
ctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaat

SEQ ID NO: 18071 - DNA, 1369 bp, Homo sapiens
  ENST00000491035
ctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcca

SEQ ID NO: 18072 - DNA, 585 bp, Homo sapiens
  ENST00000458500
tctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaccta

SEQ ID NO: 18073 - DNA, 839 bp, Homo sapiens
  ENST00000485196
ctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcg

SEQ ID NO: 18074 - DNA, 1731 bp, Homo sapiens
  ENST00000482732
cggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaaggtaaggcaggattctttgttcgtcaccccccagtccttcctccgtgctccctcaaccccacccacatacactgcactggaattgggagttgatgaaacatgagccttacaaaactcagccaacacagttcccctgagctggagatagtcgtggtgaatgtttctctattatcttctctcactttgctgcttttcttctccctacctagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcca

SEQ ID NO: 18075 - DNA, 802 bp, Homo sapiens
  ENST00000467168
ccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcca

SEQ ID NO: 18076 - DNA, 748 bp, Homo sapiens
  ENST00000406022
cgggaaaaacgggtgcggccgcctcctgtgtcctacagggggcgccagacgcatttccactcggcttggagttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctg

SEQ ID NO: 18077 - DNA, 713 bp, Homo sapiens
  ENST00000451365
ccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacataccaagcccacccttcccttcctaccattgctgggcaaagagaactgggccacaaatggctcccgggcaaagacgtcatcctcatcgttgtacacgtaggaactcaggacctgtgttttgtgtgacctgggaggacaaagggatgggcagcagtggccccacgtctttgattttggcttgcaagtgccaaacggcgctcag

SEQ ID NO: 18078 - DNA, 622 bp, Homo sapiens
  ENST00000449494
ctccaccccttccacgtcatccgcatcaacaagatgttgtcctgtgctggggctgacagccccatcccttcacctcctcctcggtgagctggaagctcgtggggaagtcaaaggcagccgcagtgtgcagcagactccggcagcgctccccgtgcagcacgacgcggtcataggtgcagtgggtgctggcccgcactgtggtgtcctccccatcggcaatcacccagtggaagcctggctcagtccgcagctccagcttgtccaggcgctttttggtcagtgaagcgcagtcagcattgaagtccccaagcaggatcacgtcctagagacacagcagccatcaggctggccgctgggccaccctatccttgtccctcctgtacaaactgcccaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctc

SEQ ID NO: 18079 - DNA, 457 bp, Homo sapiens
  ENST00000427682
ctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacata

SEQ ID NO: 18080 - DNA, 292 bp, Homo sapiens
  ENST00000428169
ctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagggggctcccatacctgctcagaccagcttgtcaccaagtctgcctcatccttaagtggatcgcgataccc

SEQ ID NO: 18081 - DNA, 2318 bp, Homo sapiens
  ENST00000424325
gggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 18082 - DNA, 2210 bp, Homo sapiens
  ENST00000618723
gggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 18083 - DNA, 1471 bp, Homo sapiens
  ENST00000325926
gcgagcgccgggaacgagcaccaccagggctggagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttt

SEQ ID NO: 18084 - DNA, 1305 bp, Homo sapiens
  ENST00000250784
ttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaatgtgttttttcccccttgtggataatagtagggtttgaatttgctcatgattttggcactgtcttaagatctctaggaataccacctatacttcctctgaccctccagtaaataaacctttgcttccctcatacatgttacccacaccatctctgtgggcagagtgatggagtagcattccaaaacgaagtacaaaaaacgtatgacatttcagaaaggacggcattcttttgtggaagctatgggagatggtcttagttttcttgcttgttcacattattggtagaaattaaatcctgtggctgtaggaaa

SEQ ID NO: 18085 - DNA, 811 bp, Homo sapiens
  ENST00000430575
gcactgtggacgctctcttgacggatgctagggagacccgccaagttttcaaaggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagata

SEQ ID NO: 18086 - DNA, 998 bp, Homo sapiens
  ENST00000477725
attgagattacaggcatgagccaccgcacccggcaaaagccacatgttcttagcagttcttagtagtggtagagttaagtttgtctctggggctctttgttaccaccgctccagagttgcccattgaggactatcaattggaaatatgtccctgaggaaaaaatgatataccagttgattgtgtgttaccactcagatacacaggcaacaggcttttagcctgtgataaaggaccagaggttagttcagctgagcactcttccagcagccaccagagggttctgaaacagattcccccttggcaaggtttcccaaatgtctaaattactaaatcagtatgggagatcatcagctctgtgactggttaatatagtttttcccaagagcactccttctctgaccgaggaaatgctggaaatcgatgggataagtaatgtctgggtgactgctttaggctggctttgtgtttacatattgaattgattttccttgctgtgtttatagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaa

SEQ ID NO: 18087 - DNA, 454 bp, Homo sapiens
  ENST00000515575
tagggactggcaagataatcaactttatcaaatttgatacaggctgtaaaaacaaaaacaagccaaacaagccagcaagcaaacaagaagaagaaaacaacaacaacacaaaccttgaaatagacttgtcagatgtaaatatttcttttctagggaaatagaaggtgtacagtggagttttctggaggctacatgacatgtgataagaaaacagactgaaaaagggaatacatctataaagagaaaattgctatcactgtttttggttgggaaaaacatttgtatgagataaacatgttattcttttcataatcagacattcttctcacaagtgttggttctctaccattcctcaaaggtgataattttttgaaatatgttattgtggattcatgattttggatatatccaatgggtttaagtgcattgcaataaaatggtattttgatactca

SEQ ID NO: 18088 - DNA, 543 bp, Homo sapiens
  ENST00000628001
gaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaagcagctcctgacctcccttgagggctctgtggctccagtccctaagcgtgcagaaggccacctcttcctgtgccttttgaccccagggtcaaggtcaagcccctgaatgagctggtggaaaacttcctccttaacctcttgctgggaaggaagcagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaa

SEQ ID NO: 18089 - DNA, 500 bp, Homo sapiens
  ENST00000627677
gaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacag

SEQ ID NO: 18090 - DNA, 3186 bp, Homo sapiens
  ENST00000629832
ctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaa

SEQ ID NO: 18091 - DNA, 560 bp, Homo sapiens
  ENST00000625208
gcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatggtaaagcttctggccctgcctgagct

SEQ ID NO: 18092 - DNA, 3131 bp, Homo sapiens
  ENST00000630838
gcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 18093 - DNA, 2596 bp, Homo sapiens
  ENST00000631108
aaattgctctgggattcctgccatggggattttacaggcactgctaggctgctcagaggttctctcgctgactcaccctctgaggtgaggaacactgccctctgcagcccctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaac

SEQ ID NO: 18094 - DNA, 544 bp, Homo sapiens
  ENST00000629025
ctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactg

SEQ ID NO: 18095 - DNA, 3023 bp, Homo sapiens
  ENST00000628081
agaagtaggaagagtaacggggccctctggtcaccggcttgagccccaccatgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 18096 - DNA, 592 bp, Homo sapiens
  ENST00000625391
ggggccctctggtcaccggcttgagccccaccatgcagaccccagcagatttccccagggttgagagagacttggttccctgtcccagaaaggtacagcagcaagaacccacagctctgcccttaaccccttcctggggatccctgccctgctgcctgcccgtgtgtctgccaggtgtcagacctatctgccctaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctg

SEQ ID NO: 18097 - DNA, 2089 bp, Homo sapiens
  ENST00000628816
atgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcagggtgagtgcccctggcctggacccttccccactcctgcagccctagcacttgggctgagtggtgcttgtctgataggaatggctcagccagccccgccccaggatggtctggaaatagggacatgctcctgcctccaggagctctaccttgggagtaccccatctgagggggagacacagtctcccaccgcagccccagccccagtatggaggccagagtctgtacccagaccgtgcgggcttttctgcagatatactccatttgccaacggtcccagtgacacaccagaggaaatcctaacccggatc

SEQ ID NO: 18098 - DNA, 3202 bp, Homo sapiens
  ENST00000626401
actgcggcagccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtaatatacatgattcaaaagaaaaatattcatgaagaagtcttcctcccaccccagccccctctattcccatctataggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagcacg

SEQ ID NO: 18099 - DNA, 580 bp, Homo sapiens
  ENST00000627022
gcggcagccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatggtaaagcttctggccctgcctgagctcctaccccacccatccttcgcccttgcctgtggtctgtacactgtcccaccgcctgcctggcaggccaagggagccagggccg

SEQ ID NO: 18100 - DNA, 2359 bp, Homo sapiens
  ENST00000628256
ccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccgg

SEQ ID NO: 18101 - DNA, 486 bp, Homo sapiens
  ENST00000627890
caccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaaggtgagtggggacacctccctgtgcagaacccaggcttggctgagggaggcagcccagacttcaagggccttgggtctggcaagggagacagctctgtcttcaggagcacctagttcaaaggtggagaaacaggcctatttctcagctatccctcgccagccaatcctcctccccctaagccaagtgctagtgactggctgtgaaggtctggaaggtggtaatagggtaaatgcaatgtgtttgtcagggggcggggccctcaactaccaagctggtcaagcagaggcattctgactgttgatgctagaagagtctggggg

SEQ ID NO: 18102 - DNA, 530 bp, Homo sapiens
  ENST00000625549
aaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactggtgagtggagggcgcctgccccctcgggacccaggggaggacaggacaaggtcatgataggtctcggctgagtgctgggggctcattcttcccgagaagccgtgccagttacttggaagtggtcaaaaactcaggcctcagacttggaacaccctcagctggaatcccagcccctcattgtgtaacgttgagcaag

SEQ ID NO: 18103 - DNA, 857 bp, Homo sapiens
  ENST00000627508
aaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaagtgagtgaagcctccagccccaccccagcctccccaggggaggcctcttctaggacagggccatcctgaggtgggtgggcatggctttctccagaaacgtctccctctcttgggcaatctgagggatgggtgagtggggtgggtggtagtgccagctgcccagtcactaatgctaccattaccaagggccaggtactttgcatgcaggtaatgttgcccgtctttttttgctaatctagtgtgacatttgagatgccacctttagaggtctttccttgataaagccctatagaattttccctaatatctaactaccctcaaatgataactaaggagccaggggcaggtggtgagttggaataagatctggctttagtgttaggcagccctgtattcaaatcctgtctccacctactagctagacttactagctcaatgactgtagagctacttaactgccctgagccttagttttcccattagcaaaacggggccctaatagtacttgcctcacacagttgcttcaaggattagcaaaaaagataggcaacacccctgcgtggtactgctaccaccctgcaacacccgcccagtcatcagagagaattgggtggagcacctcctctgggctgaaccca

SEQ ID NO: 18104 - DNA, 304 bp, Homo sapiens
  ENST00000625911
gagaccatgacactgattctgaaggcgaagctaggcatgccccagtttctgagcactgaagcccagagcctcttgcgggccctgttcaagcggaatcctgccaaccggctcggttcctcgtctcaatgggagatgatgatcccaagcttgcttcagggctctgttgatgaaatgaggttgtgtgaacatgccggcatgtagctccggccctgatggggcagaggaaatcaagcggcatgtcttctactccaccattgactggaataagctataccgtcgtgagatcaagccacccttcaagcca

SEQ ID NO: 18105 - DNA, 498 bp, Homo sapiens
  ENST00000625863
gctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatccc

SEQ ID NO: 18106 - DNA, 555 bp, Homo sapiens
  ENST00000630873
ttttgacaggttaacttagagctacctgtagacacctacacagagtcagtagcagcagcaataagaccatcatttcagccccttccccttctctcggatgccaagtccatgcacccgtccctctgcaccctgtctgtgtagctttctaatctctggccgctgacctgggccactagccacctccccacactgagaactgaccccagccccctgcccctaggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcagggtgagtgcccctggcctggacccttccccactcctgcagccctagcacttgggctgagtggtgcttgtctgataggaatggctcagccagccccgc

SEQ ID NO: 18107 - DNA, 639 bp, Homo sapiens
  ENST00000629099
aacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttct

SEQ ID NO: 18108 - DNA, 543 bp, Homo sapiens; identical to SEQ ID NO: 18088
  ENST00000525525

SEQ ID NO: 18109 - DNA, 500 bp, Homo sapiens; identical to SEQ ID NO: 18089
  ENST00000526040

SEQ ID NO: 18110 - DNA, 3186 bp, Homo sapiens; identical to SEQ ID NO: 18090
  ENST00000374168

SEQ ID NO: 18111 - DNA, 560 bp, Homo sapiens; identical to SEQ ID NO: 18091
  ENST00000524436

SEQ ID NO: 18112 - DNA, 3131 bp, Homo sapiens; identical to SEQ ID NO: 18092
  ENST00000374166

SEQ ID NO: 18113 - DNA, 2596 bp, Homo sapiens; identical to SEQ ID NO: 18093
  ENST00000526792

SEQ ID NO: 18114 - DNA, 544 bp, Homo sapiens; identical to SEQ ID NO: 18094
  ENST00000529454

SEQ ID NO: 18115 - DNA, 3023 bp, Homo sapiens; identical to SEQ ID NO: 18095
  ENST00000530003

SEQ ID NO: 18116 - DNA, 592 bp, Homo sapiens; identical to SEQ ID NO: 18096
  ENST00000366866

SEQ ID NO: 18117 - DNA, 2089 bp, Homo sapiens; identical to SEQ ID NO: 18097
  ENST00000531113

SEQ ID NO: 18118 - DNA, 3202 bp, Homo sapiens; identical to SEQ ID NO: 18098
  ENST00000374163

SEQ ID NO: 18119 - DNA, 580 bp, Homo sapiens; identical to SEQ ID NO: 18099
  ENST00000530607

SEQ ID NO: 18120 - DNA, 2359 bp, Homo sapiens; identical to SEQ ID NO: 18100
  ENST00000531382

SEQ ID NO: 18121 - DNA, 486 bp, Homo sapiens; identical to SEQ ID NO: 18101
  ENST00000525582

SEQ ID NO: 18122 - DNA, 530 bp, Homo sapiens; identical to SEQ ID NO: 18102
  ENST00000527264

SEQ ID NO: 18123 - DNA, 857 bp, Homo sapiens; identical to SEQ ID NO: 18103
  ENST00000474934

SEQ ID NO: 18124 - DNA, 304 bp, Homo sapiens; identical to SEQ ID NO: 18104
  ENST00000488985

SEQ ID NO: 18125 - DNA, 498 bp, Homo sapiens; identical to SEQ ID NO: 18105
  ENST00000403732

SEQ ID NO: 18126 - DNA, 555 bp, Homo sapiens; identical to SEQ ID NO: 18106
  ENST00000530305

SEQ ID NO: 18127 - DNA, 639 bp, Homo sapiens; identical to SEQ ID NO: 18107
  ENST00000438977

SEQ ID NO: 18128 - DNA, 26795 bp, Homo sapiens
  ENST00000614987
ggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgcaaaaaaaaaaaaaaaaaaaaaagaagtgatagggtttgtgtgttatattttcttttaaagccatcatgtgaaatgtcaggactgagaaaagtgatttttttgctttgtttacaggaatcatgcttaaagagataatgcccaacatgtttattttatagtttttgttaatgataaccttttgagcattagtttggaatttggacatgatatttatttattcctttcttgaggttatagcagcattaatttcaaccagttatgaatactaaaaatattgcactctatgtaatagtagtatatttattactaaatcaatgtatatattaatagcacaggcaaaaaatggcaaatattaaaatattttcaaaatattatattatcctgttcacattttgtccacagtggttattgggaataatattttacactttttgctggcccaaatggctacataatattgagttaatgaaagttttctactcccagctttcagttattcctagtaattatgggaaattttgtgtgaattattaccaaactattgctaattcacaaaatgtgattccatcaggcacagatctctagtaatcaagaaaatgaccatatttataattatattggacatattgggaacatatttggctcttcaagccattttttaaactgtgcatcctggtagaaaatactagttataaagtacaaactaaagggactatgttgctaatagaaaatgatccagaaaaatggtcagacagtatacagattgatgatgtgattgatttcattgtgaatattggaaattaatgggtttcattttcatttatttcccttgcctcttcttgaggaggattcgacaggcgatgaaatgggtaaaaaggcagtcagactaacaggaagaaggaaagataggctagctgtcaactgatgagcctgcctgaataatctcaaatgggcttttgaaaagaccttaacaaacactgttgcactcttgtcaaatatctttatctacaccctacttataagtaccaaaaagacagcatttgatgccaagtttgaagcagttaggtcctatgcaggctgtgtattaacatacagtgaattgcactttaaaattcagaaagctttcatttggtcacatcaaaaataaacactacaaaatatataaaaagttaaatgataggactctttttttggtattaagagtaaaatagaagaagatctaagaaatacaaatacttacattatttctccttatgacattaactttgggactagagccacaccaccccctcccttcttcacttactgattgtattgcatataattttcatgccaacataaatcctgattcatatattttgtaactgtatatgacaaattgagaggcaagaataagaaaaggaagataatagaggaaagatgttaagaaagaccagtttcttctaattactctgccagatcgtgtgtctgaaagaggttaattagcattttgaaattgattggctgagtgtggtggctcaggcctgtaatccttgtgctttgggagtataagactggagaatcacttgaaaccaggagttagagaccaacctgggcaacatagtgagacactgtctctccaaaaataaaaataaaaattagctgagcatggtggctcatgggaggccaacatgtggaggatcgcttgagcccaggagttcgaggctgcagtgagctgtgatcacaccactgcactccagcctgggcaacagagcgagaccctgtcttaagaaaaaaagaaattcattaattcttccaaacctttataaagtaagaaaccactgaattactagaatagaaagtcagtctcctgagttaatttccacattgttgtctgtcttggagtcacaggttcattacccaagaaaactgccttttaatttttttagattactgttgatttcttaagtatgtaaatgactaacttttaaatataaggtaagttattttaaagaaatctactaagatagaagtcactttttttaaagtaaggaaattccttttgtatctcagtttatgttctcaaatacactactttataaaagtatacaattgactggatacttattcaccttgcccccatttcaagcgcctgttattgtcatatttattaaaaacagggtacctcataatggtgaaaatttctaaattattgggtctatatgtgccttagactgcctgattactttggctgttctcccagtgactgataataatagcatgatttgagtgttcatgtgagaatacatctaatattccttaagatctaagtaaataagttaaattctgatatgccacttatgtcaaaataattgttatatagatgaattattactgtaacatcatgaagtatcttaaaattatatgacttttggcctctcaaatgtcttacatgataataccccaatttccagtctttaattgattgtatacctcacgtaagtgtctgtcatcacttgatacctgtatctggcactaaaacaaatgtagccggctctaatgaaatttgaagtttggataggagacattgtaaaactcaagaatgggaaaaaaaaattttaacagaagtatgtatgaaggaaatattttaagtataatctacccaaagaaaataactgctacagccaacattaaaggttttattccctgttttgttaagtaacttcactccaaattgtgacattctttagagaaaatattttccttaagagtagttatttacgtgttttattgggggagcatattttcaggggggcaacatcttgctaagaacatttgattagcctcacttctgtcctcaccttctatattgcttacttttcaagatatttcttctgagcccttttctttgtatgcccagctccctgttatgtaattaagtagttgattaccattccaaatgcttcccctacacaaggctgttgtccaccctgtttcatgaatttgtgaattaagtaggtgcctaatattttcctactattagggtgaaaaggaataagaaactaaagtggcttccaaatgtttgtgtcttggtttcttcaccctagtgcaaaataggaaatgtttattggcagtcatttcttttccattactccttttaaccacattacaaaaagctaggattttgtgtctagaaggagacttgtattaaaagacaagattcttagtagttattcatcaggcttaagtttcctggtgtatttcttgtgggagaggtagaaggacattttgtagtagtattctaactattaatataatgctgcttgggttatcagaaagtattgaatacttcagataagtcaagttagtatttagtatagcagctgttcttcagagcacaggaaactgggatagtatgtagtattatgctgtttccattattgtttctcattgcataacacttttaatttatatgttggtatacaatttgcccctttactaaaaaaaaaaatctagtttcattcttgttccttgccacattaagcagttttttcatttacgttttaaattttcttaatattagaagaaaaagaaaacagaacaaaagagaaatgtcatgacttagaaaaggaaattttaagttttatggaatactgtagctttattttctgacatttctgcttatagatagattagaaaatccttgtttcttttgtttgctttgttttaaaatccagtaaggttgaggaacttgacattttaaaactgcagttttatttttaactacataagaggctggtcatgtgaaatgtgcactgctatgttggaatggatatgtatgtgacaattaacctcattaaagctctgttgctgtggtaggcattcagttattcctaatagtttattttaggtactatactgctatcctatttgctgaaattataaatactagcaatgtacaataattctcattctttggctgaataaaaacagaaatttaaaggtgctgtgtcacataaacagttaatgcctcagtactaaagttttgaaaaatattcctaaaaacttcacaggcatgaatttttgaaaagaagaagaaaccacatatacacatagaggaatttttaaagactggcattttaaagtatagctggtaaaaatggtatgtatccttatgtgtagaatttaaacttcttgaaaataatctaagctgcaacaatctatgtaactgctcttccacagttttacataaagataagaatttgtcttactaaaaggtaaatggaagattaaaaaagatgaaaaacattgtttttcctctattctatgtggacaattaaaagtatagccaagcctcagctcaaatgagttgcctttgtgtgagacagggtctcactctgtcaccctggccggagtgcagtggcgtgatcacagctcactgcaacctccacctcctgggctcaagcaatccttgtacctcagcctcctaagcagctgactaagtagactacaggcatgagccaccatgcccagctaatttttttttaatagctacaaggtatcagtatggtgcccaggctagtctcaaactcctggcttcaagcaatcctcccgcctcagcctcccagctttgcccagccgtgagttgctttgtgagttgtcttccttaactgcatcagttcatcccatactccgtacatgcactttttctcgtatttttctgcttttctatggtgtgtccacactcatttgtgtatttctacactggtatttcactacttattaagatatctgcatgtggacctacatttataaattgtaattccgttcagagaaataagaacttgattgggacagagctgggaaatgtttgtgatgaaaattattaggaataaggaaataatgatgctgtgtgagaaagcaagtagacttaaattctgagatagaaacatctgcaatcaacatagagaaggctactttacaaaaatgttatttcagtgcccgtatggacaaatctctttaaaaggctttgtctactgtgtacataaaggaacttataagcttcataaagtgcttatttttctctaggaagcccatgtgatagctctctcctctgttttcccactccttccccagcttttcctgctgcccactgctccaaacactgacatccagtggccagagaccagtccaaatggagcactaaaactacatatagatagtgatcatattgtttaaaatgttattgcaacatggtgtgtaaagtgcacaggtctgaaatatacagctcaataaatgtttacatatatatgcgcccatataaccatcattcagatcaagatgaggctcccagtcagtcctcatacataaccaccactctgacctctgtcactgttgttgacattcctatacatggaattatccagtctataggtttttgtgtctggtttaatttgatcagcattatgtctgtgaaatgcatctatgttgttgcatgtagcaataacagtagtttgttctttttcgttgctctgtagtattccatcagataaatacatcacaatttatccattctcccactgatagacattttggttgtttgtaatttttagcttttgtgtttaaagcagccataagcattcttgtgcatatattttaatggacacgtacactcatttctcttgtgtgtccacttaaaagtgaaacagctggctgcagtgagccttgatcgcaccactacattccatcctgggcgatagagtgagaccctgtctcaaaaaaacagacaaaaaaaaggagtgaaactactgagtcataagatgaatatatatttagctgtagaagatattaccaaatggttttcaacaatggttgtaccaatttacatacccaccaataatgtgtaagtgttctagttcttccacatcctcatcagtgcttggtaccatcagccctagtagtttagccactctgacaaatgtgtatatttgattgtggttttaaccattctggtgattttgtatttcactgagattttaaggtgtattttcctgataagtagtgatgtgtggaacacctttttatatttttattagtcatttggctatcctcaattaagtgcctgttcaagtcatttgttcatatttattgggttgtctttttttcttactgacttgcaggagtcttttatattttatggatatgagggtttttgtctgatattttaccataaatgtcttctctttagtttgcttttctactttctaagtgctttcctttgatgaccaaaaattttatgaagtccaatataccagtcttttatttaattgctaatacttttgcgtcgtatttaataaatgttcacaccaaggttatgaagatattcttatattcttctaaaagctttattggccgggtgaggtggctcatgcctgtaatcctagtgctttgggaggccaagccaggtggatcactggaggtcaggagttggagaccagcctggccaacatggtgaaaccccatctctactaaaagtataaaaattagccaggcatggtggtgcatgcctgtaatcccagctacgtgggaggctgaggcaggagaatcgcttgaacccaggaggcagaggttgcagtgagccaaggtcatgccactacactctagcctaggcaacagagcgagactctgtctcaaaaaataaaactaaaagctttattgttttaccatccacattaggtttacagtccatctactgctgatatttgtatatgatgtgaaatagtagccaaagtttatgtatttccatatgagtattaacttgacccagcacaatgtattgaaaagctgagttgtaatttttatgaagtcttcatatctggtagtgtaagacctctaacttttatctaatagttctaatagttttggctattcttaatcctttgcatttccatatacattttagaatcaccttgttagttttgggggcagaggatgttagggtttaattggtattgcattgaatgtataaatcaatttcaggagaaattatatcttaccaattttgagttttccaatgcatggacatggtatatccctctatttacttaggtatttaatttgtctcaccagtgttttatagatttacatgtagaggttagatttatatctaggtttttgacagttttactttattatcaaattgtttttaattagtttatagaaatatagtttttttggtatattaccctttcacttagaaaccttgttaaattcactttttaattctaatctgtatattattttagatttctttaagtctacagttatatcgtctgtaaataatgacagtttcatttctgccttttcaatttttatttttcttgccttattgagctgatcaggacctccaataacatgctaaatgaagtaatgacaatggactccttaaacttcttcaactcagaataagaattcaatatttttctattctatatatatatatttttttcttttcttttcttttttttttttttttttttttttttttgagacggagtctcgctctgccacccaggctggagtgcagtggctcaatctcagctcactgcaacctccacctcccaggttcaagtgattcttctgcctcagtctcccgggtggctgggaccacaggcatgcaccaccaccctcagctaatttttgtattattagtagagatggggtttcaccatattggccagactggcctcgaattcctgacctcgtgatccacccgcctcagcctcccaaagtgctgagattacaggcatgagccacctcacccagcccaatattatgttttatttaatttttttatagatatcatatagcagattgttttatttctaattttcagagagtttttactaaatgctttttctgcctctgttgagataatcttgtatttttcttctttattcttcaattttcaaatgctgaaaatagaataaattccattttcatgatgtattgcccttttcatatatcaatggatatagtttgctaatattttgcctaagatttttggatcataaggaggatagacctagactgggtgtggtatctcacacctgtaatcccaacactttgggaggccaagaggaaggattgctttagcccaggagttggagaccagcctgggcaacatagagagacctcatctctacaaaagattaattagccaaggatggtggtgcacacctgtagtaccaaatacctgggaggctgaggtgggagaatcacttgagtccaggaagcagaagttgcagtgaaccaagattgtaccactgtactcccacctgggcaacagagcaggagcctagcattaaaaaaagaagaagaagaagaagaagaaggaggaggaggaggaggaggaggaagaagaaggacagacctgtaatttttctgtctttaatatttttgtcaagttttggtatcaagattattctggcctcataaaaaaaaagttggagatgtgttccctttttttctacactctggaagagtttgcacctgatattattcctcctgtttaaaataattcaccattgaagccacttgaatgagaagttttctttgtgggaaagttgtcattaattggaatatatcttgtctacttacagttaatgtaattattattggttttaagtctaccatcttacaatttcttttacatttttgtcctatatcctcttggttcctgtattgtgtcttcttttgataaaccaaatattttcttttgtccattgtttcctcctatgttagttcgttagtaatttttagaaattcatttagtaccttaaagattacagcttgtatctttgacttgctgccttaaattggtacattaccacttcccaacaatgcaggaattttatgacagtttaaatctgttttccccttttttttttttttttttgagatggagtctttgtcgccaggctgcagtgcagtggcacgatcttggctcactgcaacctctgattccctggttcaagcgattctcctgcctcagcctcccgagtagctgggattacagacacaagccagcacacccagctaatttttgtatttttagtagagacggggtttcaccatgttggccaggatggtctagatctcctgacctcgtgatctgcccacctcagcctcccaaagtgctgggattacaggtattcccccttcttccttttatgttattgttgtcatgtattttacttctacattctatgtatgttttatctctatatatgtgttttagacttcataagacattatttttttttttttgagacagagtctcgctctgtcgcccaggctggagtgcagtggcgggatctcggctcactgcaagctccgcctcccgggttcatgccattctcctgcctcagcctcccaagtagctggggctacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgacattatttttattagtagtactactactatatattttaaagactctggctgggcactgtggctcacgcctgtaatcccagcactttgcgaggccaaggcaggtggatcacctgaggtcaggagttcgagaccagcctggctaacatggtgaaaccccgtttctactaaaaatacaaaaaatgagccaggagtggtagtgcatgcctgtaatcctagctacttgggaggctgaggcaggagaaacgcttgaacccggaagagggaggttgcagtgagccaaggtcgcaccattgcactccagattgggcaacaagagcgaaactccatctcaaaaaaaaaaaaaaaaaaatagactctatattgtttgtttgctcacatatttatgttttctggtgtttttctttccatcctgccttttttacttccatctgggattacttttcttcatctggagaattctctttagtatttattttagtgccagtcttctgacaatgaattctctcagcttttgttttttgaaaccttctttcttttgcctttatttttctgtatttttatttttttaagataaaattcatgtatcatgtaatatacccatctaatcattccattcagatacaattcaatgttacctttatttttgaaggatatttttgccttgtatgaaatactaggttcaccattttattttattttatttttgagaccaagtctcactctgtcacccaggctggagtgcagtggcacaatcttggctcactgcaacctccacctcctaggttcaagtgattcttgtgtctcagcctcccaggtagctgggattacaggcatgcaccaccacgcctggctaatttttgtgtttttagtagagatggggcttcaccacattagcgaggctggtctcaaactcctgacctcaagtgatctgcccacctcggcctcccaaagtgctgggattacaggtgtgagctactggcgcccagcctaggttcaccattttcaagatatcattccaatccttaagttctgtggaaaaagccattagttatatttcctttgaaggtaatgtgtcttttttctgtggtcacttttaagattttctcttcgtctttgtttttattttttattatacttttaagttctgggttacatgtgcagaacgtgcaggtttgttacataggtatacacgtgccctggtggtttgctgcacccatcaacctgtcaccaaattaggtatttctcctaatgttatccctcccctagcccccaaccccccgacaggccccagcgtgtgatgttcccctccctgtttccatgtgttctcattgttcaactcccacttatgagtgagaacatgcggtgtttagttttctgatcttttgatagtttgctgagaatgatggtttccagcttcatccatcctaagattggtaaacttcctgaatctgttggttgatgtccttccttattagaattcttaaccagtcattcttcaaatagttttttccaatccgttttctctctcccgttttctaggattgtgtgttatactatgttccatatgtctgttatagtcctttgtttgccatcttaatttctccctgtacttcaatctgtatagtttttactgacctaattaacttatcctgttctgctgagcctaatcaattttaaatttagttgtatatcttatattttggattctaaaatatccatgacacttttttgtaggtgccaagtctctgatcatatcttgtcttttcctctatattcttgaacacattaatcaaagtaattttaaaactcttgtctgagaaatccagtgtctgattactactactagttgtttgtttccattgtctgttgtcagtcatttggtgctgttttttagcatgccttataagtttggtgaaatgtcatacattgtgtgttaaatactgtaggggctttgaacgatgttatcttcctctaagatggttatgttttcttcttgcagtctgataaaatacaggcatatcactgtaatcctattgaaggttggttttagactttgttgggcttgtacatttcagttttgctcttactcctagcatatggcctctttgggctctcatctgaaaatctagggtgtttatcagggccacttcacctcggtgaccttgaattccaacctttccctcctcagtactaagagctgctcagctcgttagcctctcatctgctgctttttgctggatttcttgaagtctcaccttgttgcacaggagtctgcaattggcagacacctcaaggagatactgtaccagtatttcaggctcacttccctgaggtttcttcgctctgggattttgccccttaagtcctagctactttcccaagctccaacttttgtctcttcaaccaagtgggattactgcttgctgctaggtatttatttccctgtgttgtgaatttgcagtgccttgaagaagtaatcaaaatgaacacagagctcaccaaagtgtgcttcccttttttccctcctttcagctattttattgcagctcgtcaagttctccctgcattggtttgctccctgttgcctataaaagatgttctacttaacccttttcctgtttgccccaagaatacttgccagcagcacttgctgctgcagtatttaccccaagataactttgccacgaactctcgcttttattattactttcgtttagctctagtatattgacttcagaaaaaaaggacatcgttctctttatagcattctgttcttagtagtggtatttccatttacaaagtataataattctcgatcgctgaaaatgtcgaatcctagaaaatgtagcattcctacacgtgatgttaacatcattctcgaacagttcttggacagagatttatttaatgaattcgatttttctgaaatagatgattttgatgattcagatgcttctgatactagatctgtttagaaataacatcaagaacagtttttatattttattttcacattgaaaatcagtcagatttgctttagcctcaaagaatgtgtttacgtaaaattaaatgaatgctggcagtgagctgtactttttttttctaaaccggaaaagggttaatatagctttcatcgttgttttcagtaggagggctagtccaatcacaagctactctattgtggccaaaagcaaaaatctggtggtaatcatttttaatcgccattgttgatttctccgcagtggcttctggcattgataacttggttgtcacatggtcatatgtgaaggcacccggtttattcatttgttcctttgtccattaaatagtttttgagcacttctttcaggccaggtattactctagacacaagcaatataacaatatttaagataagatctgtgtcactttggcacttgcagcctgtttttatagaaaggctactaaatggttgccgagtcggacttgtggtaattaaaatagacttttcttgtgtgggggttgggagtgagaaaaaagagactggaatcttttagatgattacatcttctttatataaatatttttagccttttgaaaaaactctgtagagcttaatgcagttcacagttcacccacactacatcaatatttggcctaccttttgcaagcccaattccctaactatgagtttctgtgttacataaaaatctcaccgggagcacaattatttgacaatttgagttgaaactccaggaactgatttatggagaacaaacttagctctgaaattatgtctctttatgaatatcgacatgaaatctgatgaagaatcatcctactgtggtttcccattttaacttctgtttttgaaaaacatttcagatgcaactaagcacttattaaatgcttcgtgataccaaaaaatggcttggtggtctttgtcttccagaatagcataaatttcagtgttaccaagataaaaatataatctgggcacatgtcactgttaaaatattatagtcagatcaaggattctattcctgtctttgttattctttcccacttttgaaactttatccagtggatttttttttattacaaagacgtattccagagataacagtttgtacttctgattatgatccatgttcatgtgatcaaaaggcagcaataataggacactgtcatatatggtagctccatagaaactaggctgcactgggaggacagattcgccatcttgagcacctgtggcttggtattctcgaaattgtagcccctttggaatggctgaagaactaccagttaaaggtaaagaaaccagacacacaaggccacgtattgtatgattccacttacatgaaatgtccagaatgggcaaatccatagagacagaaagattagtgtttttcaggggctggtgggagggggaaatagggagtgacaatgtatacaggtgatggggttttggggtgatcaaaatgttctggaattaggtagtggtaatggttgcaagacattgtaaatgtagtaaaaaacaatgaatggtacacttaaaatgaattttatcttatattttaaaaaatcacacacaggccgtgcacagtggctcacgcctgtgatcccagcactttgggaggccgagacgggtggatcacctgaggtcaggagttggagaacagcctgaccaaaagggagaaactccatctctaataaaatacaaaaattagccgggcgtggtagcgcatgcctgtaatcccagctacttgagaggctgaggcaggagaatcactttaacccgggaggcagaggttgcagtgagcctagatcgcaccattgcactccagcctgggcaacaagagtgaaactccgtctcaaaaaaaaaaaaaaaaaaaatcacgcatagctagaaaggctgtagctagtttgaggaagtcagtactaacacctggctattcagagaatgccatcctgcccccctttctttggcatcaactctgaagcatagttatgttatggttggaaaatcttttctaactagagattaagctcttggggacaaagtaaacttgcctcttacaggaaacaccaaagttccagcttaacagagaaagggaacctccttgggaatcatacttttcccattattgggtagtgctcggacagatgtcaaagtgctgtatgtttccatggtgatcatatccagcttatcattacttgtatctttgccctaaagtttaatttcttactttgggactcattataataatgggagcaccggccttttgggaggccaaggcgggtggatcacgtgaggtcaggagtttgagagcagcctggccaacatggcgaaacgctgtctctactcacgcctgtaatcccagcactttgggaggctgaggcgggcggatcacgaggtcaggagatcgagaccatcctggctaacacggtgaaaccccgtctttactaaaaatacaaaaaattagccgggcgtggtggcggatgactgtagtcccagctgctcgggaggctgaggcagaagaatggcgtgaacctaggaggcagagcttgcagtgagccgagatcgcgccactgcactccagcctgggcaacagagcaagactctgtctcaaaaaaaaaaaaatacaaaaattagctgggcgtggtggtgggtgcctgtgggcccagctacttgggaggctgaggcaggatactctcttgaacccaggaagcagaggttgcagtgagccgagatcacgccattgcactccagcctaagcgacagagtgaaactccgtctcaaaaaaataaaaaataaaaaataatgtaagtaccaggcctttgtttgagttcagtttttctttggtgagcacttttctaaaatctctctcatcttacctatgttaactttgtctcagaagcaggctcatttgtgcagttagctgaaatatttattcagaaagtcatttatagcagttgtcttttcatcaaacataatacctttaaaatagcagaaaattaatgccattcatgattttgccattttactaagtagtcagaagctatgtctcccttagccccatcatatacatttgaaatatctttatcctagataatctgtattcatttgaatgcaaaagttttatcaatatgagtgaacttatacatctttttattcgctgatggagatatcacttgaaactttgttcctggcaaagcaaagagatgaaatgtattgaaaaaaatcgattagacttttaaaacttcaaaatacttttatagaaaatgtaaataagattgtttctaactgcagagtgttttacataaaatctttatgtgaagaatttatattgcagtacaataaagtcagtgctttttatatgttttgaatggtaaacattttgaaggtattttttgaagtaactaggtattgacattttttaataatatattttgaataaagcacacctaaaatgcatgaacttgtgtaagtatttggcatcattagtctagttgtacatatttttaaaaataagaatgggcttagaagataatgtatttgtagtaagtatagtatattttttactgagtgagtctgatacgtcttttagatatttgagtaaagtctactgttaaagtattccagatttttaaattccagtgtccttgctgtggaatctagtgttggctttctgatgtcagaataatcaaaccctgctcatatacacatccagaaaactttttctaatgatgatacatttagcaaaatcgcaagtctttaaaaattctagttaaatagacttacttgagacaagtgtacattgtgaaatctaaaataaaaatttgtgactatataatacataatcttcattatgtaggctatttctaaaaacttagtttctgtgctgatttcatgttaagtttttcaaacgttagcagattataatggctacagtaagttttgttctaaatctggtagccatttattattaaatgattaatgattaaacattaatcatttaataattacttaggaattataaattacaatgtcaaatcttcatacatcaggctccttgcactataattacttaaaattagtttgcatcaatagtctatataaacagatatcttagtttagaggaaaaaatattctattttctaggtactttaatagtttggtcttgtgaaaattacataggtgtgtgtttatgtatgtgtatacacacatgtattgggggcttacaataccaaattaataagactgcccctcactccttaaatcgactatctgccctgccagtaatcccccacctgtactggtatatacagagttttctctggtacaaatgattaatcaagaaaaagggtgtgaaatatttgtgttcgtttctttttaaatgaataatgggatacacataaactagtaacaccacattgatttcctaaagacctaatacagctttaagagggaataacattccagagctccaggattattttaatttagctttcaagatggttacgattttgatttaatatagagacttcatagtgttaaattttagggtttttttttttttttttgtatttttagtagagatggggtttcaccatgttggtcaggctggtctcgaactcctgccctgatgatctgcctgcctcggcctcccaaagtgctgggattacaggcgtgagccactgtgcccaacctaaattttaggtatttaaaacatccattgatgctttgttttgtttttgggttttttttttattgttgttacttaagggatgcatcttatttatttggttgacttttatctagacatcataaatgtgatgcttacttttttattagccacttcattgttgatgtcttaatgggagatcttagtttgatgaatctactctttgaaattttagtttgattagtcatttgtttctgctaggttttggcttttgttttgttttttgagtgataacctaagaagtttctacagtggaaaatatcattatgacatcttcatcccttataaagttgtttcatttagaggaatttttcaaagcctatgttgagaaatgggcaaattaagtaaagcatcataacaattttttttatagtgaactcattttatttatagaacggcaaacacattcactctttttgctaacatccggggcttttttcattgtgactgctttgcacacttaaaaatgtttctcccaggccgggcacggtggttcatgcctgtaatcccagcactttgggaggccgaggcgggcggatcacaaggtcaggagattgagaccatcctggctaacatggtgaaaccctgtctctactaaaaatacaacaaaaattagccgggcgtggtggcaggcgcctgtagtcccagctactggggaggctgagacaggagaatggcatgaacccgggaggcggagcttgtagtgagccgagatcgcgccactgcactccagcctgggcgacagagcaagactctgtctcaaaaaaaaaaaaaaaaaaaaagtttctcccagcaaaggctaactggaatttatttttgtttaaagacaaatacttttaatgtggataaaataaaagttggaagtatgcctttcatgtggcaaactggaaattagtggttagtactccattgcagcattaaataccaattctttacaatagggtgcacatatcagatgctgtttttcccttaacctttgcacttttcattgaaaatgttttcaaatcaaatcttgttttattgggtttcacatgattggactaatacttacatatatgcttctttttaaggtatttagacattgacaattagttatttccttatgagccatagctttgaaaaaccattttagaagaaatttccattttttaaacaaaagtgttgggaggccgaggcgggcagatcacgaggtcgagaccatcctggctaacatggtgaaaccccgtctctaataaaaatacaaaaaattagccaggcatggtggtgggcacctgtagtcccaggtacttgggaggctgaggcaggagaatggcgtgaacccgggaagcagaacttgcagtgagccaagatcgcaccacaccactgcactccagcctgggcgacagagcgagactccgtcttaaaaaaaaaaaaaaaaaaaaaaaagtgattttttaaagaaaagataccgataatttgtctttgctgtagatgaatgccacgtttttatatactaggactattactgaataatactgtttatttctttagatcaacgaatatattaaattctgtcttttttgttcaaataaacgctgtgagatgattgggaaggctgtgtgttgaagttagatgcaaagttggaccttgtacagtgagcctcttgtgagaactgagccatgaaagataaagcctgtcattcatgtctgccttggcctgtgcccagctttattagtaaaaaccattcagtttttactaatgatatctaccagtatctaaagagaaataccttcatcctctagaagaaaacaaggttacccaaagagctcacttaattccttcctttttccctgaacccttggttttaagtgaagagtaaaatgtactagatatgacactctctctgagtattactgaggattttgtggaaaaggcagtttggtactttatttccagcttagctgcagacttggtgaccctgagcaaatcactcagcctccctttgcctccatttcttcatctgtaaaatggggttaacctgtgcctccctgtctcaccagcatactgagggatcgattaaagaggattaaaaaaatccataaggtacactgattccaaagatgggtagaatgatatttaataatgaagactttctgttatatagcaatttaattttaaaagtatctttaccaggccaggtgcggtggctcactcctgtaatcccagcactttgggaggctgaggagggtggatcacgaggtcaggagatcaagaccatcctggctaacacggtgaaaccccgtctctactaaaagtacaaaaaaattagccaggcatggtgatgagcgcctgtagtcccagctactcacgaggctgaggcaggagaatggcatgaacccgggaggcggagcttgcagtgagccgagatcacgccactgcactccagcctggggggcagagtgagactctgtctcaaaaaaaaaataaaataaaagtatctttacccacttctctgtagtgaatattgactagcattttgaagtaggaactaacaaagtataaaattaagtagattttttatatttatgggtattgttctagtacaaatttatggtgtacactgtcggtctgagtgtgggtttaaaatatatcattgtgcttggctaatttgtagaatgtcttatttgaattgacttcatttatttcagaggaatgcatagatgatcagatcaaactgtcgtcatagcagtgttttcagcacatacgagaatcttagagtttaggagccttagagctcacccagtgcaatttcctgccggaagcagattccttcctggtgacctcaccaacaggtgcttgtgcagccttttcctgaaaactttttgggaaagtgggggctgctacctcactactttgatgtgtaccttttgttcaagaactttctaaaacttggagctaatcatgggttatttcagaagatgtaagcattttaagttttttattgaattccatccttatttaaaaggcctggttatgtaatattttctgttttttttttttttttttgtatggtttcccacattgattaggttgttttcttcattttcttaatagattaaaaatactttcttctctttctatttgtgtcttcttccatttagtatttatgggagggagcaagaagggaaaggatgtctatttttaaaattgactacaatcatgactgttcttcttgtcattctgtagcagctggatttattaccatctcttatttaaaggtccttcagaacacgttgaagcagttcatttcaggtcaatggctggtaagcaatgtcaggacctctggggaaggagaagctgacgggatcccagaggaaagaattgaggttgtttgctcccttgtagaaagcccacagatcccttcccagactagaaaaaaagtgccagagtgtcctgaaactttccttctaaggcacatacttcaaagagactggggattcctttgttttaaatataggtggggtctcacagtgttgcccaggctgggctcaagcgatcctgccacctgggcctcccaaagtgatgggattacaggcatgagccaccatgcacggccatggagattctaatgtggtgccagctgccaggtaagaaagctgtgagacaatgtgttgattttcctttactacgtcaggtttgaggacatcatctagcatcaacgggtaacgtcaccctttgttccatctttgggaaataatagtagtagcttgttactgttagctgacccctacattagcatcaataaagtaaatccctttaactttccttttggcctttcctttctctctctctgcctccccaccagccccgactctctcctgtgtgcgtacacatccacacacacctccatggtattccttctttctcccacctaagggaagctgtgcccgatcttgctgcagtccaggtcaccgtactgagatgagtcagccacagactctaaacactagcagcgattagccgtatgtagccaccaagtgcactgttttagacaggtttacacagctctttgctgtccactcatatcagctgtgtagtagcccaaggcagcctgtcaggcagaagaattaccaaccaaagtggatctattcataagataaaagatccggagtccgtgccctcttaaaaaacttttgtcttcagacatatgggtgcgtgttcatctctggccaaaactttgtttccagtttcaaagggctggttgcgaaggtggccttgtaacctttctgttgccggctctgttagttgcctgataagcagtagctaattcatcctcctcagaatttgagagtggcatctattagattcagaccaccaaggtgcctgcgcgggctctcctggttacgactgagtccccttttctcatctgtggggtgaacgcttctatttgcagaaatttgcttgcatctttttccttttatttattattactttttagagatgcggccttgctctgttgcccaggctggagtgcggtggactcttttcttttgttgatctttgccatcctctgcctggcttaatgaggttctttccctgcgtatttatgtcccaggagctcaccttccccctaggtttttaagaaggaagcagaaaatgttacaaagtataagggattctatgaagtccatagataggatttgctttgggagtagatgatttcttcttattttggtgtaaacatcaatttggatggcaattagaatgtctttagcctctttaaaaagcccttctggggcaaacctttgcaagtcactcagctggcatgtaatgagatttttatttgcatggctttttttttctaagtctctctagaagaacataaggacattctgaacatgcaaggaatacagttattctcacatcaaggatcaattttattttgtatcttcattttatgtcattttcctttattttattcacattaatctagcattaattccccccagagggaatgatatttttggttgctgccacctgtgttattaagtgacagcttttctttatctgcttttctgaatttcatatttatatactttattgtagttttttaaaatctattctagctgggctagaatcttccaagtattaattcataatgaacttccctcttctggaattgtttaggagggctaatgttccatgttcccttcgttgctatagatatgaagttatttcgatgttctttgagtgctttattatagcgataactggtactgcctttgattaaaggtgagctatatggagttaagcatttttatactagtaactatttattgagaattttcagaattctatagctacttgtctttaacagttataagaggcatgtatttttttttccttcatggtctggaagttagttttctctttgtttgggtagatcggaatgagttgttgagctgtgttgaaaacacacatgaatcaaaaaagcagatgtattgtagaaatgtgatgttttcatgtttcgggaatttgaccggaaagctttatgtatgggttttatttttaacaaagcagtaagggcttactttttaccaacttgtgtgtgtgtaaagatgtatttgttcaagctttaagaataaacctgtcaatgtacaaatgcctg

SEQ ID NO: 18129 - DNA, 2993 bp, Homo sapiens
  ENST00000536315
agttttccccagcccgggaatgagcggcgggcaccaggcatcggggccagcgcagccgccgaccgctgcccgtggcacgcacctccgaggatgtcgctgctcccccttcccgcacagctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtg

SEQ ID NO: 18130 - DNA, 2118 bp, Homo sapiens
  ENST00000556178
cttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttag

SEQ ID NO: 18131 - DNA, 2249 bp, Homo sapiens
  ENST00000418736
gcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaa

SEQ ID NO: 18132 - DNA, 1420 bp, Homo sapiens
  ENST00000554206
actagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaacttgaaatcaaatcccttttttgtttgtttgttcaagactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctct

SEQ ID NO: 18133 - DNA, 278 bp, Homo sapiens
  ENST00000556304
aagaacgttaagtcatgaaatggaaaagattgtgaacttttaaatggaggacaaatagaaataaataaacaacccatgagaatgcatgccatctgcagaaaagcaaaagagctattgcaggcatctcactgaaactgtgaggaagaaaggtcctgagtgggcaagatacagagaatattaaaaagtgagcctccatatccccaagaaatgagtgctttagcgaaagacctaattcagcgtcttttgatgaaagatcccaagaagagattgggatgtgg

SEQ ID NO: 18134 - DNA, 596 bp, Homo sapiens
  ENST00000556594
agagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgagacgagtctactctgttgcccaggctggagtgtggtgctgatctcggctcactataacctccgcctcctgggttcaagtgattctcctgcctcagcctcccaagtggctgggattacaggcacccactaccatacccagctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacg

SEQ ID NO: 18135 - DNA, 756 bp, Homo sapiens
  ENST00000423108
gtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtactccagcccacctgcctgctgctttctgaggggtggagggagaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 18136 - DNA, 1178 bp, Homo sapiens
  ENST00000433535
atgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 18137 - DNA, 1225 bp, Homo sapiens
  ENST00000383820
acatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 18138 - DNA, 1149 bp, Homo sapiens
  ENST00000464783
ttcctttttagtgggcgagttcaagggactttaacttgtgtgatttgtctgcttattccagagaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctc

SEQ ID NO: 18139 - DNA, 996 bp, Homo sapiens
  ENST00000466141
cctagctacttgggaggctgaggcgggagaatcgcttgaacctgggagacagaggttgcagtgagcgaagatcacaccattgcactccagcctgggagacagagtgaaacgctggctaaaaaaaaaaaaaactgcacttggcttagggaggcaaggagctggggagacagtggtatcagcagcagcctggggagcatttgatggcccccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactgaaacatatgatctgagaaagggggtggtgtttccccaaaggaaaaggggaggagtgatactgggtggcacagaacgagtagctgcccactgtctctcctggctttcctgttgcccagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaag

SEQ ID NO: 18140 - DNA, 1005 bp, Homo sapiens
  ENST00000424438
ggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttaca

SEQ ID NO: 18141 - DNA, 907 bp, Homo sapiens
  ENST00000427174
acggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcgcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccct

SEQ ID NO: 18142 - DNA, 2413 bp, Homo sapiens
  ENST00000475470
acggtcggggcccctcggggaccagcccttcgcggggctgctgccaaaaaacctcagtcgggaggagctggttgatgcgctgcgggcagccgtggtggaccggaaaggtgaggggtgagaggcacggccgcacaaggaccgggaggggactgcctcggcgtgcagttgggctctccattgaagccacgggatcagccctgcttctgcctcccactagcagcatgagctgggacaagccacctaatttgcaccctctccccgcttttaaccctactgccatgatgcagtagggttaagagtggggagaagatgcaaataactaccgagccttgcacatagccggcgctcagttacgggagttgctatactagattattgtttattggccgcggtggctcacgcctgtaatcccggcactttagggtgctgacgcgggcggatcacctgaggtcaggagttcgagactagcctggccaacatggtgaaaccccgtctctactaaaaacacaaaaattagccaggtgtggcggcgtccgcctgtaatcccagctactcgggaggctgaggcaggagagtcacttgaacccggatagcagaggttgcagtgagccgacatcgtgctactgcgctccagcctgggatgacagagcaagactcagtctaaataaataaataaataaataatgattatttatcgacggacaaaacacaggctttggagtcagacatacctaggctctgtgatcagcttgctgtgcggctttaggaaaataactgaatttctctgaaccccactctctattcagtgatttattccttttctcaactatttcttgaacatatgctatgttccaggcactgttctaggcaggctatacagtgctgaaaaagatagatatggtttctgctctcaggggagaaatggatttctctctaacgggagaaatggatgtcagaaaataaatgaacaagttactagtggtaagtgctatgcataaactaaaacagggtgttatgatggtgaggaactgcaggaggaaggcagacattagattggagattcagacctctccgtgatgtgacatttgagccaagatgatagggagccagacctgggaaatttggggacaggaaacagcaagtgccgaggctctgaggtggcagaggaacagaaagaagttgaatttggtgtggggtagttaactcatgtctgagagtcatgatggggacatgtgctaagatgcgtgagaaagtgctctggaaactctttagtgctgcataaagggttaccgttgcttttgctgatgttcgtgtgatgtatgtttcaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatct

SEQ ID NO: 18143 - DNA, 2491 bp, Homo sapiens
  ENST00000484134
acatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctatgctcagtgtgcagtcatttctccatgacggtactcgtggcaggcattgctagtcgatccatgatactctttcctctaactgccatcaattaaagatggtacttgagatgaaatatttctgcagttccacaaactcatgagcttttttgtagagaacttatttaagagctaatatgtacagaatttctagtagaattctggcacatggtagacaatcgttacgacatttggctctgagttccctgggggccggggcaaaatgagaaacacattaagctacatagtcttgttatcaaagaaggggaaaccttacttgtttctcaggagttggtctaggttatagtcctggtgttagtgtttggcctgaagcaggtcagtgttcctaagagtttcctttttagtgggcgagttcaagggactttaacttgtgtgatttgtctgcttattccagagaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatct

SEQ ID NO: 18144 - DNA, 955 bp, Homo sapiens
  ENST00000418713
ctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatg

SEQ ID NO: 18145 - DNA, 823 bp, Homo sapiens
  ENST00000472381
gcacatgcgcgctgtcctggctcgggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggtcagcccagacattgtgaggcatttgtcagaggccgcaggatttgggaagaggcgtccggagataggaatgggtggcacctcgggatggaatgactcccattgcttctccctccttgtccaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactggtgagaggtgctggga

SEQ ID NO: 18146 - DNA, 1178 bp, Homo sapiens
  ENST00000433972
aatcagcgcgctggctggagcgcgggtctgcccctctggacgcacatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataataccta

SEQ ID NO: 18147 - DNA, 807 bp, Homo sapiens
  ENST00000433555
tgttttgggccggttctggagtggctggcggcggggcctgggtgtccgcccagtgcccgaggacgcaggctttggcaccgaagcccggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctc

SEQ ID NO: 18148 - DNA, 817 bp, Homo sapiens
  ENST00000451405
gggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcc

SEQ ID NO: 18149 - DNA, 630 bp, Homo sapiens
  ENST00000485705
aaatgcaaaagcctggaaagacatctccaaaggccaatctcaggttggacaatcgtgagctggggaagctgcaaacactgtgacctccggaataaccgctggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatccca

SEQ ID NO: 18150 - DNA, 547 bp, Homo sapiens
  ENST00000473522
ctgaattttcgaggtcagcccagacattgtgaggcatttgtcagaggccgcaggatttgggaagaggcgtccggagataggaatgggtggcacctcgggatggaatgactcccattgcttctccctccttgtccaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtact

SEQ ID NO: 18151 - DNA, 578 bp, Homo sapiens
  ENST00000460909
acatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggtgaggggtgagaggcacggccgcacaaggaccgggaggggactgcctcggcgtgcagttgggctctccattgaagccacgggatcagccctgcttctgcctcccactagcagcatgagctgggacaagccacctaatttgcaccctctccccgcttttaaccctactgccatgatgcagtagggttaagagtggggagaagatgcaaataactaccgagccttgcacatagccggcgctcagttacgggagttgctatactagattattgtttattggccgcggtggctcacgcctgtaatcccggcacttta

SEQ ID NO: 18152 - DNA, 1802 bp, Homo sapiens
  ENST00000368218
aagcgtccggagccggatgcggaaatcggtgcgcgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 18153 - DNA, 2254 bp, Homo sapiens
  ENST00000368216
cgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 18154 - DNA, 1191 bp, Homo sapiens
  ENST00000519086
cggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagg

SEQ ID NO: 18155 - DNA, 459 bp, Homo sapiens
  ENST00000524343
aaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaaga

SEQ ID NO: 18156 - DNA, 709 bp, Homo sapiens
  ENST00000484742
tttctagtacctacctagattgtttttgtaatcttcccagatccaaggaatttttcacagacaacctatgggacacactcccttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctct

SEQ ID NO: 18157 - DNA, 1096 bp, Homo sapiens
  ENST00000476229
cttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 18158 - DNA, 479 bp, Homo sapiens
  ENST00000517871
cactggaggcctcggctggactatctcaggtacagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtaggccaacccttcctgcgacctggactgcaggagcaggggctgcttggctggaattgagcacagaggctggattacatctttcaagtttctcagcttgaactggtgtggtccctaatttctattacc

SEQ ID NO: 18159 - DNA, 416 bp, Homo sapiens
  ENST00000522237
agaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttagatatgtgcagcgggggctacagcgagtggggctagatccccagctgccactgaatctggctgcccttcaggcccac

SEQ ID NO: 18160 - DNA, 287 bp, Homo sapiens
  ENST00000462397
ccaggagcttctgcaggctctggagaaagaggagaagaggaacccgcaggtaggccaacccttcctgcgacctggactgcaggagcaggggctgcttggctggaattgagcacagaggctggattacatctttcaagtttctcagcttgaactggtggtccaaaccagccctcgtcactccccacaccacgtggttaggtgggtagaccccacagccctgtgtgaggagcttctgcttccactggagaacccgtgtcagggcagggcccgcttgctgctcacaggcc

SEQ ID NO: 18161 - DNA, 617 bp, Homo sapiens
  ENST00000497515
aaaataaagcaaagttggaactgaattaggaacaagcaaagtttaagtgagaggtgacagttcttaaaaccaaactgagtgctgaatgtgactgatcccacagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 18162 - DNA, 649 bp, Homo sapiens
  ENST00000481920
aggagttcaagaccagcgatggtgaaaccccatctctagtaaaaatacaaaaagtagccgggtatggtggcgcacacctgtagtctcagctatttgggtggttgaggcaaaagaattgcttgaacccaggaggcggaggttgcagtgagccgagactgcaccactgcactccagcctgggcaacagagactccatctcaaaaaaaatattaagattcctaccaaatcagcctctggtgaacctctctaaggtgcatgttaagcaagcttcccaggcatcgagaacctacaatgcaagaggactgcctcccaagtcagtgccttgggaacccgtgttccttatggagaacggggtctccttagccccgctggatcctcccccatggggaaaagggactatgcctacaggcctgggcagaagaggctgaaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggat

SEQ ID NO: 18163 - DNA, 2331 bp, Homo sapiens
  ENST00000615459
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgagtcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 18164 - DNA, 2463 bp, Homo sapiens
  ENST00000612451
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 18165 - DNA, 2621 bp, Homo sapiens
  ENST00000356545
attccctccctggtgctcgcagaggactggcccctctccgggctgggagctccggccgagcggaggcgcgacggagagcaccagcgcagggcagagagcccggagcgaccggccagagtagggcatccgctcgggtgctgcggagaacgagggcagctccgagccgccccggaggaccgatgcgccgggtggggcgctggccccgagggcgtgagccgtccgcagattgagcaacttgggaacgggcgggcggagcgcaggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggg

SEQ ID NO: 18166 - DNA, 2320 bp, Homo sapiens
  ENST00000401068
cgcgccctcgcccctcccgggcctgcccccgtcgcgactggcagcacgaagctgagattgtggtttcctggtgattcaggtgggagtgggccagaagatcaccgctggcaaggactggtgtttgtcaactgtaaggactcatggaacagatctaccagggattctcagaccttagtttgagaaatgctgcaattaaaggcaaatcctatcactctgagtgatcgctttggtgtcgaggcaatcaaccataaagataaatgcaaatatggaaattgcataacagtactcagtattaaggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgct

SEQ ID NO: 18167 - DNA, 2487 bp, Homo sapiens
  ENST00000517939
cttttttctggaaactgcgacgagatgggaactttctgaattaagcagcaattcccgcgctggttttctggggagtcctcgcctccagagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 18168 - DNA, 2748 bp, Homo sapiens
  ENST00000517781
gcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtgggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 18169 - DNA, 3111 bp, Homo sapiens
  ENST00000276659
acttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatt

SEQ ID NO: 18170 - DNA, 674 bp, Homo sapiens
  ENST00000521502
acctcactgttttagtatctgtgagacacagatgtgaaagctacagatttaattaacatgcagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttc

SEQ ID NO: 18171 - DNA, 579 bp, Homo sapiens
  ENST00000521757
atttcttggcctgggttgaggaccttgccctaagttctacctctgtctggtctgacatccccatgagccattcagctttagcttctggcctcaactctgcctctgagtttcctctttgtttctaagtttggttgtgtattaacaactttttgggtggaggaggtagagggaagaaggggagggatattttatttagtatttctatctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgt

SEQ ID NO: 18172 - DNA, 562 bp, Homo sapiens
  ENST00000521956
acaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagag

SEQ ID NO: 18173 - DNA, 602 bp, Homo sapiens
  ENST00000520026
attttttgcctgtgtttagacacagaggttggtgtagtgaccatgtggtagatggagaagttcttgtggaattactaagctattgatttacaacagggagaatgccactaaaatagtggacaatggtgaattaaatggaaaagtctgtttgaggtttggggcaagaagcttcaaattgtaaaaatcacatgggctcttgtccttcagcactgagcagcatcatgattgaagattggagaaagtggggagagagtactcaggttaggtgtggttcacatcacttttgctttaagggaattcctcgtgtgtagggttataaagataacctaagatatggacttggctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggctttta

SEQ ID NO: 18174 - DNA, 568 bp, Homo sapiens
  ENST00000522333
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattc

SEQ ID NO: 18175 - DNA, 2707 bp, Homo sapiens
  ENST00000217260
cacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccagggggagtgtgaactgggtccctggggcggctggagcccctgcacacacaatggaaagacctgcggctcggcttggggcctggagagccgggtacgagaggctggccgggctgggcatgaggaggcagccacctgccaggtgctttctgagtcaaggaaatgtcccatccagaggccctgcccaggagagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctccatttgtcctctctttctttccacccttctatcatttttctgtcagtctaccttccctttctttttcttttttatttcctttatttcttccacctccattctcctctcctttctccctccctccttcccttccttcctcttctttctcacttatcttttatctttccttttctttcttcctgtgtttcttcctgtccttcaccgcatccttctctctctccctcctcttgtctccctctcacacacactttaagagggaccatgagcctgtgccctcccctgcagctttctctatctacaacttaaagaaagcaaacatcttttcccaggcctttccctgaccccatctttgcagagaaagggtttccagagggcaaagctgggacacagcacaggtgaatcctgaaggccctgcttctgctctgggggaggctccaggaccctgagctgtgagcacctggttctctggacagtccccagaggccatttccacagccttcagccaccagccaccccgaggagctggctggacaaggctccagggcttccagaggcctggcttggacacctcccccagctggccgtggagggtcacaacctggcctctgggtgggcagccagccctggagggcatcctctgcaagctgcctgccaccctcatcggcactcccccacaggcctccctctcatgggttccatgcccctttttcccaagccggatcaggtgagctgtcactgctgggggatccacctgcccagcccagaagaggccactgaaacggaaaggaaagctgagattatccagcagctctgttccccacctcagcgcttcctgcccatgtggggaaacaggtctgagaaggaaggggcttgcccagggtcacacaggaagccttcaggctctgcttctgcctgatggctctgctcagcacattcacggtggagaggagaatttgggggtcacttgaggggggaaatgtagggaattgtgggtggggagcaagggaagatccgtgcactcgtccacacccaccaccacactcgctgacacccacccccacacgctgacacccacccccacacttgcccacacccatcaccgcactcgcccacacccaccaccacactgccccacacccaccaccacactcccccacacccaccaccacactcgcccacacccaccaccagtgacttgagcatctgtgcttcgctgtgacgcccctcgccctaggcaggaacgacgctgggaggagtctccaggtcagacccagcttggaagcaagtctgtcctcactgcctatccttctgccatcataacacccccttcctgctctgctccccggaatcctcagaaacgggatttgtatttgccgtgactggttggcctgaacacgtagggctccgtgactgggacaggaatgggcaggagaagcaagagtcggagctccaaggggcccaggggtggcctggggaaggaagatggtcagcaggctgggggagaggctctaggtgatgaaatattacattcccgaccccaagagagcacccaccctcagacctgccctccacctggcagctggggagccctggcctgaacccccccctcccagcaggcccaccctctctctgacttccctgctctcacctccccgagaacagctagagccccctcctccgcctggccaggccaccagcttctcttctgcaaacgtttgtgcctctgaaatgctccgttgttattgtttcaagaccctaacttttttttaaaactttcttaataaagggaaaagaaacttgtaaa

SEQ ID NO: 18176 - DNA, 722 bp, Homo sapiens
  ENST00000400634
gcccacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccaggagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctcca

SEQ ID NO: 18177 - DNA, 3169 bp, Homo sapiens
  ENST00000481205
atgtttttcccacccaagaattaaatttaaccatttgaactaatgaaaaatgtcattattaaaaataccactcagtagaacccataagtattttaatatggcccaggtcacttgagttttcaatgctctttctataaacctggaagtaaattctagaatttaaacatgaattcttagagatctgatgaggaacagttggcagctaggattttgagctatctcaactacttaaaaaaagataatttatctccatgaagtcatgtgtggagaattcagcaaatgagctgatttggcactaattttttttctctggtcccagctggtttctctgaattttcagcccacccatgctgtgtcttaggtagccagaaacagtcacaatgctccactgagaaccatgctttctgtgttctcagtgcatggaagcaggtgtgtacggtgccctgtggccctcactggctggcataaccccccagagatgactcctgctctcaccctcagagtgagagtaggaacgcttagctgttactggggttcggcagcctgtctcatgattccctctgacggaattttctgtgggaatggtttgttgacagggcctacttggagcttgagatcaccctttctcaggagcagattcagaagtacacggactgcctgcagttctacgtgaacagcacacttaaggaactgaggaggctcttccttgtccaggacctggtggattccttaaaagtatagttgcttaagctgttcacttcacagtcttgactgttattttccctaaaggtgtaatactgtaaactgctacatcaagaagaataaaaagcaagtgctaattatattctagagtcagaagacctccagttgtatggcaccatgaaccagtctaatcccttcattgtaccaatgatgaaaatgtggctgagacatttgtccagggttgcccagtgagtcactggcagagctggaatcaaacccaggtcacatagcttctagctctatagtctttacaacacaccagattgtctccttaaaccatttttagttcctccgacaatttcccaaaattaatattaagataaaaaatctagatagggaatgtgaaaaccatatatacttttgcattgaaggaaactctagattctactaatattaatagtaagccctccaagtgtgcttatgtagttacagctctgaggctagaggtatgcccagcctctcacttgatgaggatcaggggcacctggggctctcactgaatttgctgggttcctttgaataagttgctttggcctcctggtgacttacacgtggaatcaaagttagtcaatcgtgattcggcatggtcataagcagagctggggaagcccagacaaggtagttgtgaagtttctgtgctctcacagcactttatacacaccctggcaggggcttgtactgggagctgtctggtaactgttcaaagaagggcagaaggaaaagtgaaaaatgtggtcttgaccctcaaaatgctttactggaataatgacttgccatataatgactgaagagagataccagggcaattataattacttaccttagtgcttttaaggccatggttgtatttgtaatgtaaaaattgtgggccagaacaggggtcagcaaaccttgtccgtaaagagacagatggtagatactttaggctttgcaagccacaccatctgtggcaccttttcaactttgccattgtagcacaaaagcagaaaaagacagtacaaaaaggaagggcttgactgtgtgcccataagacttctgaacactaaaaatttgattcaatatcatttcatatattagaaaatattaatcttgttttgattttatttgaacatttaaaaatgtaaaaacctttattaactcgtgggcctatgcaaaaaccggtcaagggccacagcttcgtagattattatttccttgagtccctcaaaccttataacaaagtgatccaaatagttccaagagaactaaggactggatcctctttcattgattctgtgatgagctttcaacgcctttcattgactatcgaaatcatgatgtattctgactcaaattcaaatctaggtaaaagtcaatgatatgagactctaacttgtcaggaagggttttaggagctctaataatgctttcgttcttcagtttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgtt

SEQ ID NO: 18178 - DNA, 1609 bp, Homo sapiens
  ENST00000395090
cgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggtttcttcaaggaaagtccatgaagtgcctgccattcacagacttcttgagcaggtggcctcctggttggagatttaggaggcttccctagagggcatgccatttctaccagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 18179 - DNA, 1703 bp, Homo sapiens
  ENST00000342503
agaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 18180 - DNA, 3435 bp, Homo sapiens
  ENST00000267484
aggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 18181 - DNA, 2101 bp, Homo sapiens
  ENST00000432103
cgtgtgtgtgcctccgtggctctccttcgctctgtgggacgacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgca

SEQ ID NO: 18182 - DNA, 1412 bp, Homo sapiens
  ENST00000474911
gaatccagatgccaggtgagaacccacagcaaccacagcttggtggagtgagccacagcggctcatgtggcggcactgcgggagctcagctgggtgtgtttggtgtctcctgcagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgata

SEQ ID NO: 18183 - DNA, 582 bp, Homo sapiens
  ENST00000557422
agccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagagg

SEQ ID NO: 18184 - DNA, 303 bp, Homo sapiens
  ENST00000490111
cagggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatgggtaagagcagataagactgtatacgtcttccttcaccccctctgtgaaaacgctgcttcctaggctgtaagctttttgtttgtttaaagag

SEQ ID NO: 18185 - DNA, 2647 bp, Homo sapiens
  ENST00000611068
ctgagacaccgcagcttccctgagcgccgagtccctccggggacagcagcagggagcgcccgcgcagccaccgagcctctgcccagccaagccgccgtcgccgcgccggtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttgg

SEQ ID NO: 18186 - DNA, 3169 bp, Homo sapiens; identical to SEQ ID NO: 18177
  ENST00000481205

SEQ ID NO: 18187 - DNA, 1609 bp, Homo sapiens; identical to SEQ ID NO: 18178
  ENST00000395090

SEQ ID NO: 18188 - DNA, 1703 bp, Homo sapiens; identical to SEQ ID NO: 18179
  ENST00000342503

SEQ ID NO: 18189 - DNA, 3435 bp, Homo sapiens; identical to SEQ ID NO: 18180
  ENST00000267484

SEQ ID NO: 18190 - DNA, 2101 bp, Homo sapiens; identical to SEQ ID NO: 18181
  ENST00000432103

SEQ ID NO: 18191 - DNA, 1412 bp, Homo sapiens; identical to SEQ ID NO: 18182
  ENST00000474911

SEQ ID NO: 18192 - DNA, 582 bp, Homo sapiens; identical to SEQ ID NO: 18183
  ENST00000557422

SEQ ID NO: 18193 - DNA, 303 bp, Homo sapiens; identical to SEQ ID NO: 18184
  ENST00000490111

SEQ ID NO: 18194 - DNA, 2647 bp, Homo sapiens; identical to SEQ ID NO: 18185
  ENST00000611068

SEQ ID NO: 18195 - DNA, 1777 bp, Homo sapiens
  ENST00000416372
ggtaccgagggtgggtgggggtgtcgggccgcctccaccccagcctcacggtctgggctcagaacctcccgtttctccgagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 18196 - DNA, 2157 bp, Homo sapiens
  ENST00000043402
ccgggccagcctaggccgccacaccctcgggcccgcgtccccggccggctccggcccgggccgccatcccctccgccgcctgcaggggccgccgcctcttcaggaatgcgccgcctttgtctgggaccgcgcggcgccggtgcaccgggcgggctgagcgcctcctgcggcccggcctgcgcgccccggcccgccgcgccgcccacgccccaacccccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 18197 - DNA, 1973 bp, Homo sapiens
  ENST00000425986
gtgtggaggagggagcaggctgcctgggtggttgtgggacgcgactcctcctaagccctggacacacttgccctccacccccgccctcgggcatccaggcgcccgtttttgagatagacgtgcccagagggaccccagccccattgcagtgtttcctaggccctgtgggtggaacccccactgggaccccccggggactcctgcaatgcgggctctgtgttcactggagtcctgaggaggtacctgcagtcaccagtgtccattccaggaggccttcaaggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttctt

SEQ ID NO: 18198 - DNA, 672 bp, Homo sapiens
  ENST00000469601
acacttgggcagcaggcatgtgcttgccacatgaccttctagcttccttcttggtctctccttgcattggcctggagtggcccagaatgtgtggagcaaagacccagtttccttgctgccccatccctccccaggagacactgagggcctggatgtccggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaa

SEQ ID NO: 18199 - DNA, 559 bp, Homo sapiens
  ENST00000474642
atgcacaaaagggccccttcgccaagcgcctgtctagcaaatgacagcccaactcagcaaatgcccacacctccccaagggtccccaggacatgggctgcctggtcctgctgactgaaggccccagcacctgcatgacggtgggactgtctgattctggcacgtgccccaggagcagcccctgcggatgagggctgctggccagaacagttttatctttgctgaaaaattgagaagacagtacagagagatcgcatctaccacacaccagtttcaccgttgtgagcatctggcattgggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccg

SEQ ID NO: 18200 - DNA, 458 bp, Homo sapiens
  ENST00000463936
aaggcaggcaggtcaccggccctgcgccctgctcatctccctcagggccacctccatggccaggggcaggcagagggcacaggggtgcccagtcaccaggtctctctgcttcatatcagtggacctgggctctgaggggggccatcaaggcatcaggctggcccactccgtccttgagtcagggtcctacagactgacaccaggtgggcctgcaagaccctcatctgcatggtcctctcatgcagggtgggcctggggaggacccagcccggctgagctgactcccagcacttctccaggtgcaggggcagcctggcagttgtctgaagaccccgggatgcacttaggagctcatcggtgaggcccgggagccggctgctggcatgggtgctgtggctgcaggcctggcaggtggcagccccatgcccaggtgcctgcgtatgctacaatgagcccaa

SEQ ID NO: 18201 - DNA, 3625 bp, Homo sapiens
  ENST00000331238
cccgctccgccgatcgctcggtcctgcaaacgcgcgccgggcgctttccccggagctcggcggtgcgtgcgagcgcccttttgctgcagccgcggcggcggtggtccgagggggcggagaggagggggctgcggccggccggccagggggcggcgtcccccctcaaaaccgcctgcgaagtgctccgggtggcagaagcaggccgccggctccgcggagcaagccgctcgccccggggctgagcaagcgcgcggggctgccgggcagcaccacggttgcttgcgggcgccggtgccctcggcgcggggctggagctcaccatgcccctgcggggccgggccaccgggcacgagcggatccccggcttgcccccgcctcgacgcgctcggattagctgcagctggcgcccagggatttgaatctggaccccgggagggagtgcgcctaggccgacctcggagcggcggccccgtggccaacatgcttcgcaaagggtgctgtgtggagttgctgctgctgttggtagctgcggagctgcccctgggtggtggctgcccacgggactgtgtgtgctacccggcgcccatgacggtcagctgccaggcgcacaactttgcagccatcccggagggcatccccgtggacagcgagcgcgtcttcctgcagaacaaccgcatcggcctcctccagcccggccacttcagccccgccatggtcaccctgtggatctactcgaacaacatcacctacatccaccccagcaccttcgagggcttcgtgcacctggaggagctggacctcggcgacaaccggcagctgcggacgctggcacccgagaccttccagggcctggtgaagcttcacgccctctacctctacaagtgtgggctcagcgccttgccggccggcgtctttggcggcctgcacagcctgcagtacctctacctgcaggacaaccacatcgagtacctccaggacgacatcttcgtggacctggtcaacctcagccacctgtttctccacggcaacaagctgtggagtctgggcccgggcaccttccggggcctggtgaacctggaccgtcttttgctgcacgagaaccagctgcagtgggtccaccacaaggcgttccacgacctccgcaggctgaccaccctcttcctcttcaacaacagcctctcggagctgcagggtgagtgcctggccccgctgggggccctggagttcctccgcctcaacggcaacccctgggactgtggttgtcgcgcgcgctccctgtgggaatggctgcagaggttccggggctccagctccgctgtcccctgtgtgtcccctgggctgcggcacggccaggacctgaagctgctgagggccgaggacttccggaactgcacgggaccagcgtccccgcaccagatcaagtcacacacgctcaccaccaccgacagggccgcccgcaaggaacaccactcaccccacggccccaccaggagcaagggccacccgcacggcccccggcccggccacaggaagccggggaagaactgcaccaaccccaggaaccgcaatcagatctctaaggcgggcgccgggaaacaggcccccgagctgccagactatgccccagactaccagcacaagttcagttttgacatcatgcctacggcccggcccaagaggaagggcaagtgtgcccgcaggacccccatccgtgcccccagcggggtgcagcaggcctcctcggccagttccctgggggcctccctcctggcctggacactggggctggcggtcactctccgctgaggacccagggcgtcagcacccagcactgccacatgtccaccaaggaacagaatttattttcttctttttttaacaagtggaagatctgctgggtttcaggaaaaggctggtagagccttcggctgctgtctggacgtctggaccctgccatgtggattataaacccaaagtgtacagccctaggcgggagggggtggcgcttctcagccggctgtcccagccagccccgcagagcgcccacggacagtgtccactctggcaaggtgggaaaaggcactccaagtgcatcctccactggcaacagtgggacaattgcccccgacggcggcaccggggctctgtggaatcccgatcgttccgagaggtctggagggccccgtggttcctggagaaagcaggacgcagagaagaacaaatgaggctcacccacgaggctgggtggccagcagtctgggcacacacgagcaggtggcatcttggctcttgcctgaggccagtcaccctgccctgaattctatcctactccaccttcagcccctccctcgggggtagcgcctctcattcctgatgtctcaggcaaccctggcagacccaggtccaactgctggggtccaagaaccaattaccaaaggaaagatcatcagaggctgaaatctagaacttcatcccgggcaatgaggttctcacagaaggtgcagttttataactaactacgtccacttatatatattcacactctacatatatatatatatatatatatatatatatatatatatatatacacaaatgcacagtccccctcccactccgttacctaactgtacgtcttttcatgtttataaactatacagaaaactgtatttgctgaactaaggattgtattggtgatttctagcaaaaacaaagtgatagaatttttgtctagaatcccaaactggcaacgatagtctccaagggacctggccttgccaagggcctggggcaaggtgtcggcgggacggtgaggaagggggaggcagcaagagtcactttgggggaccaatattcttagatatttagagcatcaccttgtttttatatgcaacacaagcctgtctgccaccctggagcgccctgtcacccctgctgtcgtagctgttggcttcagggtgagaagtgagaagcagcttattgtatatgagggagccaggccccgagggtgagcgagatggagaaggggaaggaaggggctttgggatctggaaaccagcaggccaggcagcatccacagtgttagtccaaagggtcggaccgtgtcgtcagcctagcgtttggtcagtgacggcctggacgggccaaggagactccgggcttgagcccaggcctcccgcacggctcagctgctgaatttttccttgaggctgtttggtgtgtgacccagcaagggccctgtgtgggacagcaggagggaggcgtcgggggccttagcagaaggggaacaatgagggcatttcatgaaccatctcaggcacttctgcatcacggaagacctggccctcccagccgtcctggggatgctcagggtgcaggcagaggctcgggaggccggactcaggggtcagaagcagggactggggcaggcgagcccggacagggaagaggggctccgatcaaagccggccgtgctgctggccgggggcccaggtgggtacaagctcctttgtgctttgcacaaacctgaatcccccaccagagaggatgtgtgtgaggagccagaaacgctgaatccaattaagagagaaaaataataataacaataaatgatcttggacaagaa

SEQ ID NO: 18202 - DNA, 2203 bp, Homo sapiens
  ENST00000335099
tgggcacacggacagacggactgacggactctcgagcggacagcgcagctagcggggcgcgggcgctgggcgtcgacggccagccccagccttccccgccccgtcgcgccccgccccgtcccgtcggggccgatggctcctcccgaggcccgcagcccgggcggcgcagggtagagcgccgcggcccggccacgcagcccggggactcccgggccctcccggagccccgcggggtccccgccgtgcatccggcgggctcagggagcgagtgggagcgccctccccccgctgccccctcccccgagcatcgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggatgacttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacccctgggcgtgcgactgccgcgcgcggccgctctgggcctggttccagcgcgcgcgcgtgtccagctccgacgtgacctgcgccacccccccggagcgccagggccgagacctgcgcgcgctccgcgaggccgacttccaggcgtgtccgcccgcggcacccacgcggccgggcagccgcgcccgcggcaacagctcctccaaccacctgtacggggtggccgaggccggggcgcccccagccgatccctccaccctctaccgagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggccccccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattatttta

SEQ ID NO: 18203 - DNA, 637 bp, Homo sapiens
  ENST00000533205
cgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggggaagaaagaaaagggtaaatctctgttatgcagctggagaatggatgctctgaaaatggaaggaataccagtaattgttattcattgttattattattgatctaattattgtt

SEQ ID NO: 18204 - DNA, 582 bp, Homo sapiens
  ENST00000395120
atgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacagggtcccctgcccaaaggcctttgcagctgtttttctcacccaccctcaagtctgcccacatcacggtga

SEQ ID NO: 18205 - DNA, 3956 bp, Homo sapiens
  ENST00000389908
agctgacacagtgagttgtccctgacactcatgactttcaagccctgtgtcttggagggcactgtgatctggaagttcaccttccccatgaaaaaacccaaaccagcctctccttttcctgcatggtgatccgtctgtaatgatcagtgacattctcagaattaaccaatcaggaaattcttggaaagtccacgcctcagcatttagtgcttgggaaattctacttccagatcccagaggggacagagcagatttccagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaa

SEQ ID NO: 18206 - DNA, 1736 bp, Homo sapiens
  ENST00000487195
tactggtacaagccactgtgctcagcctcacttttaaaatatgcatttttttgtttctgagattgtttttctctgttagttatctgcatttcttctttccgtgaattacctattcccatcctttgtgcatttttgtatttttttctcattgatttatcaaggtctttatgatgctgcttcctaacattgtatatatactgcttcacaatttataaagcacttttcctatgtgtaataacactcgatccagttctgagttgcattttgtggtctcagaatagttagcctaacctgccttcagtcttcctgctagtgagaggagtctggactcccacccagatttccagatcctaaaatgaatgttccttttgctacactgcagtttgcaatttccatcttccaaatccaggagtattttgggaaggttttgtttttctgacgtctgttccacaagagcagagctcatgaatggccatgatttaattccccaagtctctgctggagccttcccagctgtcatgaggttgagtatggctttatcatcatgaaacaagtcatcagagtctttgaatcttgcgtaggaattggaagtcggggtataccaggataggttttcagcaccaggtgtggcactcaccctccggtatgcttggcagagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 18207 - DNA, 2361 bp, Homo sapiens
  ENST00000378784
ggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 18208 - DNA, 2754 bp, Homo sapiens
  ENST00000441284
cgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggcaagttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 18209 - DNA, 2731 bp, Homo sapiens
  ENST00000378787
accggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 18210 - DNA, 2997 bp, Homo sapiens
  ENST00000409879
actccttcggcgttggctcttgcgccggggtcgttgtttcgtgacaaccactcaggtagccgtttctgagacggcagatgcggccgctttagccctgagcgggctccgcggctccctggacggtctctgccagtgcccgactcttctcttccggactccacgccaagcagcgaccctgagccaacagccagagcgcccagaaatggcggcctggactgcctcgcactggccagtcaaggggatcctgaagaacaagacctctacagcttcctctatggtggcctcggctgaacagcccagcgggagtgtcgaggaggagctgagcaaaaaatcccagaagtgggaagaaatgaacatcctggcgacatatcatccagcggacaaagactatggtttaatgaaaatagttgaaccaagcactccttcctgtcgtaagatgggtgatggtgaagatgcgtgtagtggtatagaaaccactgaagccgtggcaccagatatcttagctaagaaattagctgttgctgaaggcttgaacccaaagtatcgggttcaggaacaagaaagcagtggagaggaggctagtgacctctcacctgaagaacgagaaaaaaggcgacaatttcaaatgaaaaggaagcttcactacaatgagggactcaatatcaaactagctagagaattaatttgaaaagacctacatgatgacaaagatgaagaaatgttaaagactgcaggtggagaaagcatgaagacggaagaatcaaatcaaagctctacaacaagtgaccaacggcaaaacacattcagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggataaaataaaaaatggggatattgacctcctgtcactactgcatggactttgatggtttccaatcattactttctcctctgtgtcaatctgcctcttcgagaaattcatactcctggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgacccc

SEQ ID NO: 18211 - DNA, 1948 bp, Homo sapiens
  ENST00000631139
cccctttctgctgttaccgggagcgcggtggccacggaacgctgcccggagccgcgcgagggaggacccgacgcgcggcgtttacccagcgcagcgttccaccgctcgggtttggctgggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaa

SEQ ID NO: 18212 - DNA, 494 bp, Homo sapiens
  ENST00000417405
gcgcggtggccacggaacgctgcccggagccgcgcgagggaggacccgacgcgcggcgtttacccagcgcagcgttccaccgctcgggtttggctggaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgg

SEQ ID NO: 18213 - DNA, 972 bp, Homo sapiens
  ENST00000439642
ttaatactgtgtctctggtggctctagtgatgcaatcattctcgatggggccactgactctgatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaag

SEQ ID NO: 18214 - DNA, 3206 bp, Homo sapiens
  ENST00000378797
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctgggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 18215 - DNA, 3322 bp, Homo sapiens
  ENST00000378781
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 18216 - DNA, 3979 bp, Homo sapiens
  ENST00000429979
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 18217 - DNA, 7537 bp, Homo sapiens
  ENST00000523629
atcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcc

SEQ ID NO: 18218 - DNA, 3463 bp, Homo sapiens
  ENST00000396218
tgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 18219 - DNA, 2370 bp, Homo sapiens
  ENST00000360348
caggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaa

SEQ ID NO: 18220 - DNA, 2450 bp, Homo sapiens
  ENST00000422361
tataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaaga

SEQ ID NO: 18221 - DNA, 2103 bp, Homo sapiens
  ENST00000520724
ttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaatt

SEQ ID NO: 18222 - DNA, 781 bp, Homo sapiens
  ENST00000521078
ctttgttttcctaaatgtatgtcaaaagatctgctagtttttagactgctggaactgcccaataatttggatgagagtcatgcttcttctatagaattctacaaaaaagtaatcagatagtgggcatggtggctggaaggctcctgtaattccagctgctaggggaaattgatgcagaggataacttgagcccaggggttcgagaccagcctcggaaagaaaaaaaaaattaaaagaaaagtaatccgtatccaatgacttcggctaactgagaggtgttttcttgtctggtttggcctgactggcacacagaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagac

SEQ ID NO: 18223 - DNA, 2453 bp, Homo sapiens
  ENST00000518844
acttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctag

SEQ ID NO: 18224 - DNA, 870 bp, Homo sapiens
  ENST00000521751
gtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttg

SEQ ID NO: 18225 - DNA, 882 bp, Homo sapiens
  ENST00000520978
gactcctcagagctgcttctcgatgtgaacgaaaacgggaagaggcgaactccagacagatgaataaactgaggtccagagaggttaagtgacttgaccaaggtcacacagctagtcatggaagagccaggactagatctcaggtctcttgattcccagtccagtgctctttccactacaccacaatgccagtaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagccc

SEQ ID NO: 18226 - DNA, 431 bp, Homo sapiens
  ENST00000518361
gcttctcgatgtgaacgaaaacgggaagaggcgaactccagacagctattttcccaccagctctttcccagtatttcatatttgaatgtattgtgacttttgactatccttgcacagtcttaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaa

SEQ ID NO: 18227 - DNA, 1872 bp, Homo sapiens
  ENST00000520047
gggttgataggtgcaacaaacgaccatggcacacatctacttatgtaacaaacctccacactctgcacctgtatcctggaactcaaaaaaaaaaaaaaagttaaaaggagttcttcagagtaaaggaaaatgatataggccagaaacttggctctacataaagaaataaagagcactgaaggaaaaaaaaaatgaatttgaggtacaagtagccagccgtagttcctgtccatgattctctagaaggctattttttaaggctgttgggcccaaaaattgaggcagctgggacctctcctgtattcagaaatgcttttctacctgatgggttaatcggtgtacatggcacctggttcctacaaatgaaatcttcaagttgcaaagagatttatgtgattgatctttcctggaattaagtgtgattggggatgagtgctgttcactcttcccagtatcttctcctttcctctcccttactgcccctccccaaacaataataaaaataagagaaagagaaagcaatgacaatctggatttataatgtcaaagtaagttcagagtaaaatgccttcttaggttttcattttaatgcctttactatgtgtgaaattgcctctttctctcttattacatttgaaattgccagaattaccgatcagcctatcaaccagcccgttctttattcaaggtgctgacctagctgaggaggaagagtgaccagtatacaggatttcttctaacattagaagaaatatgtgtgtgtgtgtgtgtgtgtgtgtgtgtattcattccttagaataagactgatacaaagaaggcagtttacttttgtagactactagaatatactgctttatgcattaattccatctgggatatgtgactgtacccaggccattacttaactattgtctgaacttgatgactatggaaaataatctctatgttcatgtctatatttttaagtgtattttcattaagttagtacttgacaaaagatattttctgggattagcctgcttgacctttgtgagtcaccagatacaaaattgagtgtgtcagggaaactattctgaaattaattggactgtgtatatattttttataccctctatcttccctgtggagaacaaaagttcttatgattggagctaggttctcacataccgtagaacatacattcaagtataaagggaccctaaaaataatgtgccacttgcaatgttatcagtgaagaaataaaagagaggtaaagtgatgtacaagggtcagtcacctcacacttagggcaatctgcgcacatggtagcccagtgctgagaattgtgcctgtggttccagcccatggcatgcatttgacctttgatgtagctgcattgcatactcttctccagtgttcgaaaagcagagtaagtcaacaggacagaagaaaactttcagtccgtcctctcattcctgtcattcccttgcaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagcca

SEQ ID NO: 18228 - DNA, 1346 bp, Homo sapiens
  ENST00000521553
atcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggtttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttccc

SEQ ID NO: 18229 - DNA, 504 bp, Homo sapiens
  ENST00000522316
acatcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtgccaacttgcccctgctgcagcgtgagctcctccactgcgcaagactggccaaacagaaccctgcccagtacctcgcccagcatgaacagctgcttctggatgccagcaccacctcacctgttgactcctca

SEQ ID NO: 18230 - DNA, 976 bp, Homo sapiens
  ENST00000518992
agaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcct

SEQ ID NO: 18231 - DNA, 585 bp, Homo sapiens
  ENST00000521054
aacataagtgggaagctatttattcccttgttgctgaggttggttgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgccc

SEQ ID NO: 18232 - DNA, 2061 bp, Homo sapiens
  ENST00000523290
tctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccgcttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcc

SEQ ID NO: 18233 - DNA, 1044 bp, Homo sapiens
  ENST00000519847
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactg

SEQ ID NO: 18234 - DNA, 548 bp, Homo sapiens
  ENST00000517792
attttctgagttcccattatatagtgtcctatgtgtgttgctcttttccagtcagactcattagtagtctggtgtggagctagtagctcagagattgcttttatgaggcggttttggaatcttcatctgcccatgaaaatagaatagtccacttttaaaaaaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaact

SEQ ID NO: 18235 - DNA, 690 bp, Homo sapiens
  ENST00000522467
agtctgaaaaattggcacctgcaggatttgcatgtgaaaaaaacggagtcagttgcattttgccggagtctattacttatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtg

SEQ ID NO: 18236 - DNA, 782 bp, Homo sapiens
  ENST00000517919
ttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagt

SEQ ID NO: 18237 - DNA, 572 bp, Homo sapiens
  ENST00000521733
gagaagaaaatagccagctttagataaagcactataacaaaggcttctagttttatatatcatggtgtccattaaagcttaatagggaagagtccattgaacctggctgggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 18238 - DNA, 574 bp, Homo sapiens
  ENST00000520556
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 18239 - DNA, 730 bp, Homo sapiens
  ENST00000521319
tgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagct

SEQ ID NO: 18240 - DNA, 573 bp, Homo sapiens
  ENST00000520583
actcacacacaatgtgccatcctgacaaggcttttacttctgataagctccaatgtgtgtttaatgaatacaaagccgcggtctgggtgccgcctcggccgcggccgctctcccgcgctcctttgccagaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgcca

SEQ ID NO: 18241 - DNA, 553 bp, Homo sapiens
  ENST00000523168
tatgcaggcaacatagcccttcatagcaaagcagtctgaaaaattggcacctgcaggatttgcatgtgaaaaaaacggagtcagttgcattttgccggagtctattactaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgc

SEQ ID NO: 18242 - DNA, 586 bp, Homo sapiens
  ENST00000519577
ttgcagctcggagcctgtggcggatggtgggactctccggccctgtgcagttatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcct

SEQ ID NO: 18243 - DNA, 556 bp, Homo sapiens
  ENST00000518823
aatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcct

SEQ ID NO: 18244 - DNA, 557 bp, Homo sapiens
  ENST00000521897
ggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatggg

SEQ ID NO: 18245 - DNA, 574 bp, Homo sapiens
  ENST00000518317
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggctt

SEQ ID NO: 18246 - DNA, 596 bp, Homo sapiens
  ENST00000521375
ctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacc

SEQ ID NO: 18247 - DNA, 630 bp, Homo sapiens
  ENST00000519422
actcactcacacacaatgtgccatcctgacaaggcttttacttctgataagctccaatgtgtgtttaatgaatacaaagccgcggtctgggtgccgcctcggccgcggccgctctcccgcgctcctttgccagaagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacc

SEQ ID NO: 18248 - DNA, 565 bp, Homo sapiens
  ENST00000524215
ttttatttgcagctcggagcctgtggcggatggtgggactctccggccctgtgcagtaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagcct

SEQ ID NO: 18249 - DNA, 564 bp, Homo sapiens
  ENST00000520974
ttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctaca

SEQ ID NO: 18250 - DNA, 591 bp, Homo sapiens
  ENST00000518832
gagggcgggcgagggagacgcagacgccgcctgtgacagtggcaattccctgcgccccacatcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattct

SEQ ID NO: 18251 - DNA, 569 bp, Homo sapiens
  ENST00000520172
agaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaacc

SEQ ID NO: 18252 - DNA, 708 bp, Homo sapiens
  ENST00000517493
acacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaa

SEQ ID NO: 18253 - DNA, 542 bp, Homo sapiens
  ENST00000522065
agaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactact

SEQ ID NO: 18254 - DNA, 548 bp, Homo sapiens
  ENST00000518954
acttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctcca

SEQ ID NO: 18255 - DNA, 544 bp, Homo sapiens
  ENST00000519061
actcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcct

SEQ ID NO: 18256 - DNA, 563 bp, Homo sapiens
  ENST00000518256
gaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatcta

SEQ ID NO: 18257 - DNA, 491 bp, Homo sapiens
  ENST00000520428
aagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaat

SEQ ID NO: 18258 - DNA, 631 bp, Homo sapiens
  ENST00000522163
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgataaaccccacttgaaaaactgaggtgcttaaggagtaaaataatatgttcctggtggcatcctccagatcgtactgagaagcact

SEQ ID NO: 18259 - DNA, 535 bp, Homo sapiens
  ENST00000521902
actcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcact

SEQ ID NO: 18260 - DNA, 547 bp, Homo sapiens
  ENST00000522860
acactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaa

SEQ ID NO: 18261 - DNA, 553 bp, Homo sapiens
  ENST00000518449
ctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaaca

SEQ ID NO: 18262 - DNA, 7401 bp, Homo sapiens
  ENST00000613886
tctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18263 - DNA, 7627 bp, Homo sapiens
  ENST00000617740
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18264 - DNA, 7687 bp, Homo sapiens
  ENST00000613302
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18265 - DNA, 7372 bp, Homo sapiens
  ENST00000615601
atcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18266 - DNA, 7454 bp, Homo sapiens
  ENST00000436581
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18267 - DNA, 7483 bp, Homo sapiens
  ENST00000614812
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18268 - DNA, 7284 bp, Homo sapiens
  ENST00000265814
tatgcaggcaacatagcccttcatagcaaagcagtctgaaaaattggcacctgcaggatttgcatgtgaaaaaaacggagtcagttgcattttgccggagtctattactaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 18269 - DNA, 2009 bp, Homo sapiens
  ENST00000595090
gtgtcccggccccgcctcggccgtgagacctccagggggcggagcttgccgctgcgctttacggaaacgagtggccttcagctctgtcaatctggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacacctccagagtgcggattgagaagcc

SEQ ID NO: 18270 - DNA, 1641 bp, Homo sapiens
  ENST00000601968
gggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttgacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccgggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgaca

SEQ ID NO: 18271 - DNA, 682 bp, Homo sapiens
  ENST00000596837
actcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacg

SEQ ID NO: 18272 - DNA, 572 bp, Homo sapiens
  ENST00000595811
gactctggcagttggtgagcatcatggcaaccgttgaactccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctg

SEQ ID NO: 18273 - DNA, 959 bp, Homo sapiens
  ENST00000594017
actctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctaaggtcctccgggagcccccgtgaccctcagcgctctggaatgtccctagtcctgactacctcct

SEQ ID NO: 18274 - DNA, 497 bp, Homo sapiens
  ENST00000598768
agttggtgagcatcatggcaaccgtttatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagccacaaccaaagtcccggagatccgtgatgtaacaaggattg

SEQ ID NO: 18275 - DNA, 1563 bp, Homo sapiens
  ENST00000596247
agttggtgagcatcatggcaaccgttacagccacaaccaaagtcccggagatccgtgatgtaacaaggattgagcgaatcggtgcccactcccacatccggggactggggctggacgatgccttggagcctcggcagcttcctgatgtggtagaaatgccatggtagccccacaggaaatcacctcatgtgcgcctcccacccacaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcaccc

SEQ ID NO: 18276 - DNA, 1478 bp, Homo sapiens
  ENST00000221413
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaagggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 18277 - DNA, 813 bp, Homo sapiens
  ENST00000593570
tcatggcaaccgttacagccacaaccaaagtcccggagatccgtgatgtaacaaggattgagcgaatcgagatggagtttccccgtgttagccaggatggtctcgatctcctgacctcgtgatccgcccgcctcggcctcccaaagtgctggaattacaggcatgagccaccgcgcctggccaaaaaacaataaaaaattaaaaaaaaaaaaaaaggatgaagagccaagcaccgcttgtgagctgaggacccagtagagactagctgcacccaggagcctcccttggggtgctcacagtcaagcactggggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccgg

SEQ ID NO: 18278 - DNA, 1853 bp, Homo sapiens
  ENST00000594338
acagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctaaggtcctccgggagcccccgtgaccctcagcgctctggaatgtccctagtcctgactacctcctgggcctggggtttccagatgaccccatttagcctcccagctccatttcctggagctccagtctcccccagacagagggctttaggggcccccttcatgcccttccctgccctgtctccgccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacact

SEQ ID NO: 18279 - DNA, 546 bp, Homo sapiens
  ENST00000595002
ttcagacgcagggaattttcatccctcaggttggcttctgtatcatccagcctggcctatagtaggtatcagtaaatctctcttgacttaagtagatgctgttaggtccaccttacagataaagaaactgaggaatgaagaggctgggcccacaacaaggagatggccaggcaggatttgaacccaggcaatctggcccagaatgccctcccctcacatgccacactctgctgcctagagcatggaggtggcatacgctggggtctgtgccttgagcctcacggagaggggcccaactgaggactcgccctccccctccagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 18280 - DNA, 1065 bp, Homo sapiens
  ENST00000627972
atggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccgggtacagaagtgcaggtggatgacatcaagcgggtctactcactcttcctggacgagtcccgctccacgcagtacatga

SEQ ID NO: 18281 - DNA, 153 bp, Homo sapiens
  ENST00000640699
ttgcacccccagacagccacaaccaaagtcccggagatccgtgatgtaacaaggattgagcgaatcggtgcccactcccacatccggggactggggctggacgatgccttggagcctcggcagcttcctgatgtggtagaaatgccatggtag

SEQ ID NO: 18282 - DNA, 120 bp, Homo sapiens
  ENST00000639391
ttgcacccccagacagccacaaccaaagtcccggagatccgtgatgtaacaaggattgagcgaatcgagatggagtttccccgtgttagccaggatggtctcgatctcctgacctcgtga

SEQ ID NO: 18283 - DNA, 2735 bp, Homo sapiens
  ENST00000460056
aaccacaagatcataggccctaaagcagaaacaagcttaaactatggaggaatagaaagaagacaatgtgagtagggtgtgaagcaagggagaaagtcgtagggaatcgagactggacagacagaggcaacaaaaaccattgagaaccttgtacgtgttggacatatctagaaggagtcatctttgaagcagagagaaagccctctccagataccaaatctgctggcaccttgatcctggattcccagcctccagaactatcatctaacctatactgactgataagccttctaaaagcaaaaggaagaaaacagctttgttaatcgaggcctcttctgcaaagttcaccatagtttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctctt

SEQ ID NO: 18284 - DNA, 751 bp, Homo sapiens
  ENST00000472969
aaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttacttcctcctgaagaatgaactttcaaacttttttattaacactccatctcccacctagaatcaaatagtattacaacagctggtactgcctcttccttcgacacagaagaaaacctaaaatccagtaagacagagtggcatgccaaatttgcccatcaatttattggcacattcaagaataaagcaaaactctactgaatatcgatatagtagtatctgcctctgaggattcttggtgcatatttttgcattctgccatgtttcgtccattttgcccctaccttgggcatttaaatataaagattcccatgagatcggatcaattcagctgtttatttctagaaatgtctataaagagaagaactaacaagagaaccatctttttatttttttaatttacttcctaaatataaatgaaggagaatctagaaccactgtcttcattggaa

SEQ ID NO: 18285 - DNA, 3842 bp, Homo sapiens
  ENST00000307765
aaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 18286 - DNA, 3676 bp, Homo sapiens
  ENST00000342048
aatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgacactctaaagaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 18287 - DNA, 1775 bp, Homo sapiens
  ENST00000471616
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtccagagcagtaaaggatggctctgaaaaatgaagaggactgggcaaaacaggtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgcttcagaattcagtcattattctatcataggaacttgtgaattactttctccaagattttatatgacaccttgagcttgttgcgttgggagaatttcagtggaagagcagaaccaagtaatgccatcctcatctgagtccctaactgaatgctctacgtgattgcattttgttcatttattcgacacttctatgtgatgggtctagaacaatagacaagatctgtgctgttagagacttgcactttaaaggaaaatgaagaaatgattgcataattaactgtagagagtaactttgagagtggttaccaaagagagtctatgaatagatcctcatctgtaaatgaattattaggagaataaaaattacctcttcct

SEQ ID NO: 18288 - DNA, 2130 bp, Homo sapiens
  ENST00000343542
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 18289 - DNA, 2175 bp, Homo sapiens
  ENST00000470033
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtgtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 18290 - DNA, 569 bp, Homo sapiens
  ENST00000484785
gagaaatatgtctatttacatacatcatgtttgtttctgaccttgtgggacaataacttggaatgccctgagcaacaaaaacataaaacactctgatgagacagcatctcatccttgcactgaaggatttcaaaagagggacagatcacccagaatggacatggtcatagaggaatttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggtgagtgaagcccctgcagtcacggtgagagaaaggagcagaaaggactgaaggtgaagtcgctgagacttctctcaacaaaaagacaaaactaaattgaaatacaaaacatatgttgcttaaggaaatcttacacttatttcagtagcttaaaatatccactcttttcttttcttgtttttgtttttttttgagacggagtctcgctctgttgccagtctggagtgcagtggcgtgatctcggctcactgcaacc

SEQ ID NO: 18291 - DNA, 3771 bp, Homo sapiens
  ENST00000613319
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggtgagtgaagcccctgcagtcacgtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 18292 - DNA, 3930 bp, Homo sapiens
  ENST00000423548
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgttcttttcatttctttcttttcattaccctcctcttcctggtccctcactgtcatcatgccttaccacttccccttgattcagtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 18293 - DNA, 3861 bp, Homo sapiens
  ENST00000448688
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgacactctaaagaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 18294 - DNA, 15377 bp, Homo sapiens
  ENST00000355481
atctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 18295 - DNA, 15117 bp, Homo sapiens
  ENST00000359596
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctga

SEQ ID NO: 18296 - DNA, 548 bp, Homo sapiens
  ENST00000594111
gacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcgtgggtacctccctgggcaccattctgccaggtcctgtggtctctcccacagcttgtctactctggccctgcct

SEQ ID NO: 18297 - DNA, 6263 bp, Homo sapiens
  ENST00000594335
gaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtg

SEQ ID NO: 18298 - DNA, 2200 bp, Homo sapiens
  ENST00000599547
aaacttgctgctctcgtccgccaccgagtctctctctttggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaa

SEQ ID NO: 18299 - DNA, 421 bp, Homo sapiens
  ENST00000600337
gctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggcttggttctgggaggagcacttggcagagagggcgggagcaccctctaggacttcctacctggcctgtcctcacccagccagcccgtcctgggcgcaatccctgcagtcctcagagcagcccctcttacctcctctccctctcccttcctccccagctccttcctcctcctgtatcttctccctcctcccatctccctcctcctctccatctccctcttctctcatctctgtctccttcctcctcctgtatcttctccctcctcccatttcc

SEQ ID NO: 18300 - DNA, 863 bp, Homo sapiens
  ENST00000601514
cgtggtcctggctctgtgggacctggcctaggatggaaacttaggtctggaggcggagtcaggaccctgactctgttggtggagacaaggttttccttctgccgtaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgagga

SEQ ID NO: 18301 - DNA, 515 bp, Homo sapiens
  ENST00000596431
gagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactggagagaaggtcatggcggatgatgaattcacacaagacctgttccgattcctacaattgctctgtgaggggcacaataatggcgctctgcagtggctgccaaagttctatacacgtggtggatttctgtactttaggtccagaaaagacctaagggaaaaaactgcctggcatttaaaaataaatctattagaatc

SEQ ID NO: 18302 - DNA, 843 bp, Homo sapiens
  ENST00000593322
cacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcaggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggac

SEQ ID NO: 18303 - DNA, 432 bp, Homo sapiens
  ENST00000593677
aggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctct

SEQ ID NO: 18304 - DNA, 16562 bp, Homo sapiens
  ENST00000366574
ccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 18305 - DNA, 4523 bp, Homo sapiens
  ENST00000609119
tattgagaaacgatttgcctatagtttcctccaacaactcattcgctatgtggatgaagcccatcagtatatcctggagtttggtcgttcttcctttaattgatcagtatttcaaaaaccatcgtttatacttcttatctgcagcaagcagacctctctgctctggaggacatgcttccaacaaagagaaagaaatggtgactaggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaacacgatattatcaaagatttaagaaacaaatttgccagcctcggcgagaactctctggaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccga

SEQ ID NO: 18306 - DNA, 108 bp, Homo sapiens
  ENST00000609253
gacggtagaaagagtattggatatagcaaatgtgctttttcatcttgaacaggtggaacatcctcagagatctaaaaaggctgtatggcataaactactgtccaagca

SEQ ID NO: 18307 - DNA, 1425 bp, Homo sapiens
  ENST00000608590
agcttagccatctaattttttagcatgcattggaatcctcagaatttttggttgaataagaatgaattttaaaagtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggaggttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgt

SEQ ID NO: 18308 - DNA, 567 bp, Homo sapiens
  ENST00000466626
ggtggggtcagcctcaccgaaacaaacagcatggctgccacctacggactgaactccattgatgtgaagtatcagatgtggaaactaggagtcgttttcactgacaacgtaagcctacttcattatcacaaaagaaaatgcactctgattagataagactgtgggagttctgcagatggaaggctggttatttagaaaatgtttcgaataccaattcatttcatacagaccagatctggagagagacccacagaatgatatgattaatgagcccatctctcattccatttctttcaatagctgaaatagtaaaatgaaaatatatgaaaaactgagatgcagatttgtgagtacgttcattaaggttttaattggacaatggcatacttcagttttatagatgttaaaaagaaactcctaaataattttaaaagaacattaattgtgctaaatttaggttttccccaaattaagtacattaacttatggagttttattttattttttttattctccttttaccaaagagcctttggagactaaatatagggccgtaatatatatcca

SEQ ID NO: 18309 - DNA, 802 bp, Homo sapiens
  ENST00000462585
aactgtagatgggatgtctcatagcttggtatttgatttggccttttctaaaggaaagtaatctgtacctattcccccttggtcgtccgactttgtttgggtgggtactaagtttgtagtttcagttgaagacacagttaatcctgcttagataactttagtcaatgtcatgaacaagagttgatcactaagcctggacattttcacctaggctagagaaaggaagagacgttgcttttcagccatcatcatcatcatcttgttccctgtctgcgtctgctacttcttgctgctggtacctgtgtcatttaagccaacaccaagatatagttacagcgacagttccatttatattcgtgggcttggcacagcctccatgtgatgatctttgacgtgtattgagtgaaccaaataatagctgcccctacatggcgagttgtgttttccttttgttttgctttctgaactctgacgttaatatttccctttgttttctagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctct

SEQ ID NO: 18310 - DNA, 14850 bp, Homo sapiens
  ENST00000360064
gatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggctcttctctctaaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctcgtcacagcagcattctctcggagagcttatgttttgtttgtttgttttcataggggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaat

SEQ ID NO: 18311 - DNA, 15591 bp, Homo sapiens
  ENST00000634891
ggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaatac

SEQ ID NO: 18312 - DNA, 15557 bp, Homo sapiens
  ENST00000415757
gcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaat

SEQ ID NO: 18313 - DNA, 15552 bp, Homo sapiens
  ENST00000389232
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtacc

SEQ ID NO: 18314 - DNA, 15078 bp, Homo sapiens
  ENST00000634418
atggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccagacacaaaattaataatttcttcctgagcacctttcaacaagtttggctggaaaaggttaatgaaaaaactcagtatgacaggcttatacccattttaatgaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacacgtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaa

SEQ ID NO: 18315 - DNA, 137 bp, Homo sapiens
  ENST00000634750
gcgaggacgagatccagtttctgaggacttacattcctccagatctctgcgtctgcaattttgtgctggaacagtccctatctgtcagagccctgcaggaaatgcttgccaacacaggtgaaaatggcggcgaaggg

SEQ ID NO: 18316 - DNA, 100 bp, Homo sapiens
  ENST00000635875
cttgactacatcaagatcccagacagacaaacttgcctttgatgtaggtctacgggaacatgccacagggaaaatgaaaatgacagacatagtcaagagc

SEQ ID NO: 18317 - DNA, 100 bp, Homo sapiens
  ENST00000636753
gactagctgaaaacatccatgagctttggggaatgaataaaatagaacttggctggactttcggcaagtgccagctggtcaaaacttaaatcacattctt

SEQ ID NO: 18318 - DNA, 100 bp, Homo sapiens
  ENST00000636583
aagggactgggtcaaggtcaggccctttggtatgtcaaggaaacagatgcaagaaatactctctcatacaacaacacagtgctactacgccatccgcatc

SEQ ID NO: 18319 - DNA, 8528 bp, Homo sapiens
  ENST00000635790
gggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaaggtacaggtcaaatgcatgacgtgtcttttctgtcctagtattagaggtgccgggctctggccccctctgcactgtgatcaccatgggggtggtagagaatggattttcccgcctggaggtcccccaggcctgctccagggaagacaactgcctgtcaaagagtgaatgtaggcctacccacccttggaatggggaagccggggaagccagccaagcctcaccctaaccgagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactg

SEQ ID NO: 18320 - DNA, 100 bp, Homo sapiens
  ENST00000636417
ctgaagccccttagcagcagcggatatgcctcccataaggagaaagaaatggtggccggcaaccaattgaggtatactgtgtgggagtacccgtggggct

SEQ ID NO: 18321 - DNA, 100 bp, Homo sapiens
  ENST00000637201
gtctgcctgggctgagtgtgtgatccacatggtgcagtgataagcattcagcccctgaaggagggacacagatgaagaggtcagagaacatctgcggaac

SEQ ID NO: 18322 - DNA, 143 bp, Homo sapiens
  ENST00000638085
caaactgttatcaaagcaacggaaacgggcagtggtggcctgtttcaggatggcccctctctacaacctgcccaggaatagaaattggaatccttggcctatggagctattgcagtctgcatagtataagggcctggctaaga

SEQ ID NO: 18323 - DNA, 100 bp, Homo sapiens
  ENST00000638038
ttgcagtctgcatagtataagggcctggctaagacaatcaaggcaccgctctattaacctcttcctccatggctatcagagattttggatagaaacagag

SEQ ID NO: 18324 - DNA, 161 bp, Homo sapiens
  ENST00000557931
attgtctgtcttctcccttccctgctccatgaaatccagagttgtcaaagtggtgaggatgaagaagaagatgaagacaaggaaaaaacattcgaagagaaagagatggagaagcaaaaaaccctctatcagcaagctcggctgcatgagcgtggtgctgc

SEQ ID NO: 18325 - DNA, 451 bp, Homo sapiens
  ENST00000558060
aaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacacgtaagtaactaatgaatgtgaaggccattctcttcctgattaaaatctttttttttttttttttttttttccccatacagagtttcgctcttgttgctcaggctggactgcagtggcgcgatctcacctcactgcaacctctg

SEQ ID NO: 18326 - DNA, 100 bp, Homo sapiens
  ENST00000638145
gaaagatcctagagacctggtatctctgcacttcttcacagggtccctggctcctgtcagagcaaagaggaatcaatcagtgatttctactggtattatt

SEQ ID NO: 18327 - DNA, 3714 bp, Homo sapiens
  ENST00000635749
tggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccagacggggtttcaccgtgttagccaggatggtctcgatctcctgatctggtgatccacccacctcagcctcccaaagtgctgggattacaggcatgagccaccacgcccggcctgaagtcctcctcttaaccaaatagcctgcttggtaagagacctcgtcttaacgtaagattgagaggcaattacatgggcaggtaaatagagccgtctggtagggatatgaagacctgtggaggcaagcctgccttcctgtaggcatgtggcactgtggtgggaagaaggaagagcactgattgacaggcaggtgacaccaaggctctgacgcttactggtctgtgaacttgcacaaggtaatcaagccttctcagccttagtttcctcatcagtaatagaaggatgagaatatcatcctgcagaggattaatgaatgtatgtgtcaaatgcttggcaaatgcctggcacgtggtaggcattaagctgttactcattctcttttctttcctgtaactatccaaaaagtggccatcaccattagcaaatgtcacactctaatgacagttgattcacaagtaagtgacagtttcaagataaattaatgtggcaaaagaaaagaaatagggccaaatagtaaacaaaggtgactgtgttgaaactcttaggtgtgccaattaagataggcatgttaagaaacagcaaccctgactccaggggaagaaagctgtgtcctatccaaagatgatcaggcaaactgagaagcagctctgcaaaggtacaactaaggatatttatttctttatattctccagaaaaggaagcctcttcccttagaagggggaaaatgtgaacaggcacatcctcacatcctaagtctgtccctgcctgcgggtcccctgccaatcttctcacacaaggaaaagcactgtttctgatgctttgtcattacattacagaagtcttagacactattgaatagtttaatcctttggtaagctttgtgcaatcatcagtaatgcctgcgtcttgttatacaggggcatgtggcctaaaagtcccagtaagaaggcagttcaatttcggccaggcacaatggttcatgcctgtaatcccagcgctttgggaggccgaggcgggtggttcatgaggtcaggagttcgagaccagcctggccaacatagtgaaaccccgtctctactaaaaatacaaaaaaattagctgagcgtggtggtgggcgcctgtaatcccagctacttgggagtctgaggcaaggagaatcacttgaacctgggaggcggaggttgcagtgagctgagatcacaccactgcgctccagcctgggcgacagagcaagacttcatctcaaaaaaaaaaaagaaggcagttcaatttctagcaatgtatcctaaggagataatgagacaagtacactaaaatgtcctaacaaaggtatttcccaatattttttacttagagtggcttaaacgtccatgagtaggaaatgcataaataaatagctattttttaaaatgttagatagaccaatgtttaattttttttcacaatggcatcatagtacatgttcatgttttgtaacgtgctttttttcagttaactgtatgtcatgggagctttctttttaaacattttac

SEQ ID NO: 18328 - DNA, 100 bp, Homo sapiens
  ENST00000635842
gtcagatcgagctgctgaaggaactcttggatctccttcaggacatggtggtgatgcttctgtccctcctggaagaccggttccatgagccagccaagga

SEQ ID NO: 18329 - DNA, 100 bp, Homo sapiens
  ENST00000638032
gatcgagctgctgaaggaactcttggatctccttcaggacatggtggtgatgcttctgtccctcctggaagctgacaggccagaagaggaggaagaagat

SEQ ID NO: 18330 - DNA, 3026 bp, Homo sapiens
  ENST00000637948
gttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgccaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaa

SEQ ID NO: 18331 - DNA, 2973 bp, Homo sapiens
  ENST00000636845
gttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagattcaaactgtttagcatttcattcctcattaagtacaagtctgtgtatgacagacaggcttcctcacatgtccaaacctttgtacgggagagggagaaaagacggaagttacagtgtgccaagctcatgccgtgtcccagttactgtgacagcctcacaactacctgttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccac

SEQ ID NO: 18332 - DNA, 2743 bp, Homo sapiens
  ENST00000634730
agagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaatacctccagggtctggactct

SEQ ID NO: 18333 - DNA, 100 bp, Homo sapiens
  ENST00000637984
caaggatgaaccccctacattagagagtactgtacagaagaagaggaaagctcaggctctgggaatatggtgctgaataagaaacacactgtccctacag

SEQ ID NO: 18334 - DNA, 100 bp, Homo sapiens
  ENST00000637615
ggaaagctcaggcagcagaaatgaaagcagcaaatgaagcagaaggaaaagtagaatccgagaaggcagatctccctttttgggccagaccgccctcccg

SEQ ID NO: 18335 - DNA, 1874 bp, Homo sapiens
  ENST00000638052
gttattgtgctttgtcactgttttaggctctgggaatatggtgctgaataagaaacacactgtccctacagcttagtggagaataaaggcattggacaagtcaagacaagtataaagaatgctaggaaggagaaatgtcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattt

SEQ ID NO: 18336 - DNA, 100 bp, Homo sapiens
  ENST00000636656
acacaagtttcctctttgaattgagcagcagaaatgaaagcagcaaatgaagcagaaggaaaagtagaatccgagaaggcagacatggaagatggagaga

SEQ ID NO: 18337 - DNA, 2257 bp, Homo sapiens
  ENST00000636568
ttgagaagccggaagctttcacagccaatttctttaaagggctggaaatctatcagaccaagttactgcgagtgtgtattttgagccaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccac

SEQ ID NO: 18338 - DNA, 137 bp, Homo sapiens
  ENST00000637522
caccaaccctgcgtgccctggccatcatccataccatcatctctctagtctgtgtggtgggctactactgcctgaaggagactgaaggggaatgcttggaatcccagagatgagcaccgctctacaacttgatatta

SEQ ID NO: 18339 - DNA, 702 bp, Homo sapiens
  ENST00000559917
cacggcaggcattagtcgctgagctttgcctcacctcccacatcatctgtgtactaacagtcatcatcagttcctcacagtgtgcagtggctactagcctttgccaccttcctatcgtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagt

SEQ ID NO: 18340 - DNA, 374 bp, Homo sapiens
  ENST00000559333
gtgatggttggggcaagtggattattttccaatccctttctgtgtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccata

SEQ ID NO: 18341 - DNA, 3156 bp, Homo sapiens
  ENST00000637072
gaacattcttatacctgatacacaagttgaaggatttctctagagtatagacccaggagagaaatttgctgaatagtaggatatgcaaaatgtttgtcccaatttatgctccaaacagtactatattcgagtttcttcttctctgcttatttgctggcacttattgctggcagataattttgctgatctagtaggtgtatagtggcacctcattgtatgtttccctgattactaaatgggttaagcatcttgtactttttccctgaacattcatgtacagatgtactctttatttatgcactttccttctgaaggtctgttctctatgccacactttaaggactcgtaacaagtaaaaaatctgttttctaccttcaaggagtttgcatacctagtcaggggacaagaaattcagaatgctcagatgaaggtaagaccgcatctatgaaggggtcatgcccagagcctgtggtccttggcccttcagcatcactcgtggaatcttctgcttaggagaaaatgcgaccaggctgagttgtatgttaccatttgtataaatgatttaagagaaaggaggtatcagtgtggcagagagcgcatggcttgatttttatttgttttattttcaatttaaatgcagtgcataaaaaaatcaaggagcaatgtacaaggaagaaagtcaaaataattgttattttcatcccccagagataaaatattagcagtttactctgtaacaccagcatttgtttttgctttcaagtggcatttaaatgtttaagacaaagaaactgctttaacaaaccaaaaaaaaaaaacatttttttttaaatactgccaccctgttgggggagaggcggcatgagaggtcagtgaatagtaggaggtctccatttccttatcaccaacttgggtggtctctggagaatagggaactgttgtgttctagaaccaaaaagaatgaatcaaataaaggaaaacaaaagtaagaatgcatgcaccaaaggccagagactcctaggctgcaatccagtcttacaaggaacccccccacaggaaggattcagtaattctggataggaacaacatattttcaatggtttttgcaagcattcctgaagatgacagttctttcttaactttaacagtaagaaatatttgcagtggagctggtacaagctacagagagaagaaagatcatctctctggggatgctaggggatggtacagaaccatctccaaaaaagaaagggatccaactcctggaggaaagcaggccctgtggcattacgtgggaatagaaaatagagtggaaaaacactcagcttaaaaaatccaatgtaaataaactaaagatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtt

SEQ ID NO: 18342 - DNA, 581 bp, Homo sapiens
  ENST00000560791
tagagcctgtgatgactctgaacttcaatcagatcttaaaattctttggtgagcaggacacaaaccagaaagatcccagatccaggcactcaaactgaaacgtttcttgatgtgttttccttgatgttaagaatgaagaaccaacctttttcgttttgtttttcagatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtt

SEQ ID NO: 18343 - DNA, 100 bp, Homo sapiens
  ENST00000636497
ccgatatgaagtgcgacgacatgatgacggagagtgtcctgggaagacagaagtgatggaggtagttttcattaccacacatctaagccccgtggaaagg

SEQ ID NO: 18344 - DNA, 149 bp, Homo sapiens
  ENST00000636878
ccgtggaaagggaagcaccctgcacagtggcgtcatcattcatctatttccgggtgttaccttttccacatgtacgtgggagtgagagcaggaggtggcattggtgatgaaattgaagaccctgctggtgatccttatgaaatgtatcg

SEQ ID NO: 18345 - DNA, 15564 bp, Homo sapiens
  ENST00000622037
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtaatgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaacacatgcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtacc

SEQ ID NO: 18346 - DNA, 573 bp, Homo sapiens
  ENST00000368715
ggccctgggagtttgctgcccgaatctccagagcttgcgcagcggatcttgcaaatgttcactgcccagagcatgtgttccccactgtgcacaccctcccagccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 18347 - DNA, 755 bp, Homo sapiens
  ENST00000481009
ggaaaaaatgctgttgttgaggcaaggcctgggaggccctgggagtttgctgcccgaatctccagagcttgcgcagcggatcttgcaaatgttcactgcccagagcatgtgttccccactgtgcacaccctcccagccaggtgcgggggcccactgctctgggctcccccagggagggagcagagtctcgccaagtgctcctggagggatgggagtggagcctggcattctgaacacatctctgaggggtgggattaataagacggtctctgtgcctcctgctcccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 18348 - DNA, 566 bp, Homo sapiens
  ENST00000354332
ttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 18349 - DNA, 537 bp, Homo sapiens
  ENST00000468373
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggcctcttctccctccagaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 18350 - DNA, 600 bp, Homo sapiens
  ENST00000368716
agtatccgctctcccctgtcccctgctatgggcagggcctggctggggtataaataggtcagacctctgggccgtccccattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 18351 - DNA, 531 bp, Homo sapiens
  ENST00000368714
tcctttcttgggaggctacaaatagtgacgccctgtctctaagctcctacagctgaaacgccagcaccagtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 18352 - DNA, 877 bp, Homo sapiens
  ENST00000291700
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagca

SEQ ID NO: 18353 - DNA, 971 bp, Homo sapiens
  ENST00000367071
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagagagatggagtctccctatgttgcccaggctggtctcaaacttcctgtgctcaagttatcctcctgccttagcttcccaaagtgctgggattacaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagca

SEQ ID NO: 18354 - DNA, 839 bp, Homo sapiens
  ENST00000397648
ttgctcctagtcactgtctcactttcagattgattttaacagcttgcagttgatggtttgctcacctgcactctaccacctcatcttggagccttgcaggaacagagagggaccctgtggggattaattcaggggaaattaatccctgaattcccttgctgctctgcctctgtatttttgccagtttccctgttggcccaacccagccagaattcagagggcatgggaatatatccccgtggcccacacggacagagaaggcaggcccacagctgtctaagaggccggtggaaggattatgataaaagtgcaaattcccagaatgcccctccaggccatgcctgctgctctgagcttgaaaagagtgccaaggccattccatcccccttgtctgggttgaggtctgtattgataacatatgaaatgttttaggatgaggtatagatgagaaggcaactttcctttgcgagcccctaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtagga

SEQ ID NO: 18355 - DNA, 2909 bp, Homo sapiens
  ENST00000305352
ggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaaga

SEQ ID NO: 18356 - DNA, 763 bp, Homo sapiens
  ENST00000475821
tggccgcggcgagcgggactggccattggagtgctccgctgcggagggaggggaccccgactcgagctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgccta

SEQ ID NO: 18357 - DNA, 505 bp, Homo sapiens
  ENST00000475289
acagcaaggcggggcgggcctggctgcccacacctcactgcgccctcggaccctaagcacacctgctcctagagagttattaatagagcccccaaatggcttacgctttcaaatgattttcctgcaaatctgatttcttgcatggcacatggcaattaggaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatc

SEQ ID NO: 18358 - DNA, 2341 bp, Homo sapiens
  ENST00000333430
ctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgca

SEQ ID NO: 18359 - DNA, 2191 bp, Homo sapiens
  ENST00000439028
ggctaaggtggcccccactgaagactcctgctaagcaacccactgaagacccctccgaatcatcgacggggcgtccttggggtgcagcccaggaagctcagttcacagccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttattttt

SEQ ID NO: 18360 - DNA, 565 bp, Homo sapiens
  ENST00000590601
actgcgggtggcgcacgaccagggcgcagagtgagtggactgcactggacctttgggggcgctgggctgggcctgacccggagggggtcgccctggcggccactttcccggtctaaaaaggcgcaccactccttgcagggagttctccgaacttttcctggaggcctctggggagggggaagctgggggctccccagctgggtgcaggacctgggatacggggtgaaggtggctggaatcccctggccaccccctcctggccgggccactgcaagtttccatacttcagtcctgctgccgggcaagctgggcggatggggttggcctccccctcagagcatgtgtaaccctgtctccctgtatttgggctccccacctccagcatggccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagaga

SEQ ID NO: 18361 - DNA, 1698 bp, Homo sapiens
  ENST00000617721
cgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtc

SEQ ID NO: 18362 - DNA, 5146 bp, Homo sapiens
  ENST00000251020
tttttattctgccccagctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 18363 - DNA, 565 bp, Homo sapiens
  ENST00000566102
atgtcgcggaggaagcaagcgaagcctcaacatttccaatccgaccccgaagtggcctcgctcccccggcgagatggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgac

SEQ ID NO: 18364 - DNA, 3896 bp, Homo sapiens
  ENST00000570206
ctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagat

SEQ ID NO: 18365 - DNA, 407 bp, Homo sapiens
  ENST00000562674
gggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatgccttcgtagatgaccacacaccatttgtacaacagaagttggtgttccccatgctgggcaaacaatgggaagccatcctgtctttgaataggatgttagcttggagttagagatttttctgtttaatttacaaatggatcttagtgagaagacatctgagcaaccaatggaaacaaacatgaaataaagggatttttataataaa

SEQ ID NO: 18366 - DNA, 5253 bp, Homo sapiens
  ENST00000440970
ctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 18367 - DNA, 1982 bp, Homo sapiens
  ENST00000453675
agctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacaggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaat

SEQ ID NO: 18368 - DNA, 625 bp, Homo sapiens
  ENST00000524796
ggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttt

SEQ ID NO: 18369 - DNA, 520 bp, Homo sapiens
  ENST00000445741
gaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggatattcaggaatatggagatatccctgactcttccaaaagaatgaccaagatcatgcctaattacctccatgtcctgggaaagccccgctgtaatggagatggcatctt

SEQ ID NO: 18370 - DNA, 202 bp, Homo sapiens
  ENST00000527515
ctgaaggtgcgagaagaagtcagaaatctacagttactcacacaaggaaatgctgaatgatgtacaagaagctaatacaagctgcacctgtgggacagggaatatggtggatggagagagggtgtgtgccttttatgtcactttgtttgatgaaatgtatgagtatattaactatttaaaggaataaaatttttaaaaagaa

SEQ ID NO: 18371 - DNA, 2172 bp, Homo sapiens
  ENST00000314727
gcgtgaccgcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggtaccctattgcttcctgatgggtggatggatggggagattagaagaaagaccaccttactattaggacagacaggagtcagggagaatttgttattgtttcttcacagaatttccatcatagaaaatagtatacagatttaagattacttccctttgaaaacttttttcatagctcactagggagaaggatgcacaaataagtaatggatgagcaaacagaattacctgagctaacttcaaggtggtcacgtacagttgtatggattgtgtactgcacaaccccagagaataccagtcacatcaatcagggtacgattgcactcactagagttgtataatgtgcagcctgcacaactgtacagtccagctgtagctatcttcacctgcgccaattgtgagggcgctttagcatttgagtgattcaatagttacgatgaccagtgatataagtggagtttttgttgtatttttgttttgcttttcaccggttagtgggagaaaaacattttagatatgtattactatacatgaatgtattatacacacacactttagagattgtaagaaccccatttagcttcttgaaagtggaataatttttataatagactatagtgaatctaaaactacactgttaagagtatataattcttaacaggaattataaataacttcaatatgatgagagcacttaagatctcaataactgtggaagtgacaaaataaagctagaattcgaagaaagccttaagttacactatatgtaactgatatgtctacatgagatttggatgctatcaaccttcattggctataaactttatttgttttattttagcgtccattgtacatcgttttaaatgaaaggatgataaaatatgtgtttttgagagccttgagtatttgtcattctgcagaatattgtaattgcatgcataccgatattggagaaatctgggtcagccaagtttcatgttattgcatttagattaacctagtaatagtccatttgcctagaggaaataatgtgctccctgaaagatgactattctagaaggataaatatagatttcaagtgatcgtaaaatagtattgtttgtctcatatgcattatttgcattttgtcctcagagatttccaatggtgaatttactggtatactaagtgatttaaatttgaatgtgaaatactgataggcttttaagcttcttttaagaagtagatagaaatacgaagattatgataagaaagtctgtcacagtgctatttggaaaacggaaaatttacaagcaacctagaggtccagcaatgtgaaaagaatcaagtaattctgcttaaattcataagattcagtataatgcccagttattaaaattacatctttaaagaatacatgacaacatgggaaattacgtaagtcatacaaggtgggaggaaaggtcatgtgtaaaattgtatgcataatataagcccaattttgtaaaaaccatatattcttatatgtacagaaaaaaaggactgcaagtaaatatgccaaccattttaataaaggatctctctggattgtggg

SEQ ID NO: 18372 - DNA, 592 bp, Homo sapiens
  ENST00000526328
gcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaag

SEQ ID NO: 18373 - DNA, 507 bp, Homo sapiens
  ENST00000526765
acgccctgcgcgcgccgagccgggagccggctgcctcgctttgcgtgaccgcggcagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaag

SEQ ID NO: 18374 - DNA, 8866 bp, Homo sapiens
  ENST00000409003
gcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaatacacagcccattggaaaccacccacgcctgagatttggaaacctgacggaaagggaggaaggtccaaatgagtcagcagcaggatgactcaccacaagcctggcaggctgcagagccagagaagggggcttccaacaaggaactcagagaagttgcagtcaccaccaagatctggcccttcggcaggtcagcaccaggactgccaggccctctgcagaccgtaattctcttcacatctataattaggaggccaaactccagctgccaacacccttggacacaatattccagtctccactgcccatctcatgtggttcagttctaatagcaggtcttcttcttcctttcattccttcctttattcagcaagcatttgttgagcatctactatgtgccaagcattgtgcttgggcaacaacagtccacaaagcagactccccacctgcccttatgaaactgtatctcctcctccccaacattatcaccaccccaccatttccacaatgaaaactgaattcagacagcattctccattctgccagagtaacctaggaagaagaacatggcagcagacggatcctcagggaggaggcagcagagtgacagatggtaaactgcatcaggccacatatttgcacctttcagatacagccaactcttccagggcctagactgagctggttggagctccccaaagcagcattcagttgcttttccttgatatccaccctggctacctatattccctttctttatataggcacaaccattcaccactacgctggattatctaacactccaattctataactcatccaggggacacacagttgagtctgatgaagcctaagaactgccaggtgctgagatattgtaactgggaattaagatttagccaaggacattgtgagactactgctgactctcttggaaaactggacatgctttgtagtgcaaatgttcactaaatgatggtggttcattgttacttactttggcctttgcaaaatattctgaacaattcaataagtagagtttcctagtttgtttgtttttttaagtcaaaggaacgctgtgaaattattgaaagatgatgggtgaagagggacctaggagaaggcaaaatgaagaccattaaagagccccattgaagactgtatctctaaaaatgccttaatgcctggcacatattccatatttgcatatgaactactattcttttccaaactgtcaacttctgtttgaaatcattgtgggggatagtttggaaatatggtggcataaaatccaagcagtcaagagctaaaccagcaaaaaagaggaatgacttcattcacaggctttggcttctttattatgtggtggtcctctgtgatctcccatggttaacttcaactgtgctgtactttcttcccaagatgcatgtacggaatgttacctcctagaaatccagaaatagttgtggtgagttttgtttgataggaagcaagaggtggggaagtaaaggatacatatttttatgtctaaggactgtaaactgttgatgcttgacttttccttttacctacacctgtgctacacctttattaaaaggctgacacccagacttgtgcaggaaaggcactcttgggaatgaacagaaatgaataattatgagactttccatggtgccaaggggattcgcttatttccactccagaactgaatatgcagagcattgccagtcctgctagtgtgaaaagcaaattacttcaatagtttgagacgtacctaggggaagagagatcctatcaactttctttgcgggtagtggcgtaccttcaaatccttgctcaggctctgtgaggtgtgcacccgcagatttcacttctacctccggaatcctggcaaacaagccaggaatctctccagagtcacttcgcagttgctcagaaagaggctaacggtccttagtcctgaggaaattctgccatttttaacattcaaggagaaaaggcgtatcagctgtacgtgagaatatcaactaaggataaaaacctctaatggatcccccttgttacttgcaaatgctttctttgtctgcaaatgtcacataattgattttgcataggaacaacaaaagtctcaaggaattgaagtttttaataccccccttagcactttactttcaccaaaacctcctctttctagtacatgagcagttttgttctttgtgatgttttcctctacattctttagaataattttgttacttgacaactagacttgtcaatcgtcttagactcttttgaaaaatctaatctttgaaaatgacacaaattcctttattgctttaaggctgttttcattcacccctcccacagccccctccactgcacttttttgttttttgcggggatttttttctttcatctctcttcttttaacatgatgctgtgggtagttttcaagaattctataaagaactcaacaaaaagtgtatttgttacctttttccccagtcctaatatttcttcttaagcttgatcttggtgaaaatttgttgcccaaaaagcagtgaggtagggattaataacgctgaccagtcatctggaagattaattaatcccagtgcagccctgagatcaggaaggaggacaggccaggagatgtttctactccaggcaccactaaggactctatttcaaaggcagatcctgctccttagtctttttagatctgaatctaatcctgaatccagaaaattatcctatgaattctggtttatcaacgcacatgattcctggcaccattgcatagcttcaaggtaaaagagagccttgtttccattattttgctatggtggcttttgggaagacagagagcattcttttgaaagcgggaaacttaaggaaaagttggccaagtacacaggaaagttctaccacaccttaatataaagaacaaaatagatgcttctcatttggggaaagtagctaaaaggacagtaacagtactgatggccttctgtccatcaccttagctccacagggaaaattctgggtgagagcaagcactgtttctaaaatctaaattttttcaggtgaaatttaccagcaacaaatgtaaaagggaactgccatcaggcatagggctagttttatacttcctgcctaacggcaaaatgactgagacatgacttccatggaacagcagaaaatggatgccaaagatatcataaaactgaagttcaatttgccacgtaaggctatttaaaaaccctgatgcactccaagcattcttccttcagagctttcctcctacaattatatcaagcacaagaaggcaccaacagcatatacttaatgtaatgtaaaagtaaacatatgacttgtgttgaattaccattggctggttgacataataagtgtcatagatatttagacattatttctgatcatacaaaattattttcataatttcatattcttttcaattttcataaattcttttcaattttcataaattggagccaatggtttgggaggttttttgtttgtttgtttgtttggttggttggttatttgttgcgttgttgttttccaaacctcagatattttgagaagccttagaaaggctcttaagcccaggcctttttgcctcatgtgcagagtattaataacagccctactgatgtgaacctcaaggaaggaggctattaaattaatccatcactggagatactaatacctcaaacaattaaaacactgaagactctgctggttgccttccacattgtttataacctttttaaattcagtcatttggatcaagagaaataaatggttggtttcatatggcttttgccacattagcacagacacatctaccaaatgtagaagtccagactgagtggatgcatgagagcaaacagatctgtaatatgattgcatttaatcaccgccaccgcccaaattctgtaaaaatatattcaaatatgtaatgctaaaaaaaatgcaaaacaggagactcttactagatcatgctttcacttagggtaggataactgatcttgaagataacttcatagaaaaatttgctggctgaaatgccccaggcacctcagggttggtcctgtcctattccacaaactgatcatggtcttctcccatcttctcagaggagttagccttgcctctaaaatagcaaaaatgccatgaaattatctttctaacctctatagagacttcttatccaagtataattccaaaaatatgatttgagtttgagcatgcctgtggtccttgattctatgatccctaaatcagttctacttttctcactctctctctctctctctctctctctctctctctctctctatatatatatatatatatatatatatatatatatatatatatatatatatatataatctccagtattttttttcaaccacaatttagtgcatttagcgtgttaatgttgggaactgcctgctggctctatgtctacttttgacaatgcttatgtccagataccatacagtgcatttgagagaggaccaaggttatgttttcccacataccagctgctgcagaggtttcgaagtgcctgacccagttctttttcacatcaaaaaggccttcggttgcagatggaaaccttaaagatgaatgtagagtggggtaggaaattcatgtttgaatgctgaaacccttgtcttttttagttttattcaattcccacctcagatcaccagaaagggaggcctctttggtgggtgttggccctcactgggggtaaaaggggttctatttgcttaaactcatgctcgtaggcaattttagggctctctggggctctgaatggtttctccaccaccacctttcttccaccaatagaaagatgttgtccttacaaggccatgtctgagaagaccatggtttaactagtaaaagaagctcacattgcagagagctgaataataccaggctcttgactttgtactgtgtgtcacagtcatgattgggacagaaggaaccagtctgctgaaaagtcaagccagcacaaatatttggaaactaattccactgaaactcttgtatcattaaatcatactattgtagtttcagttaatgtaattatttaatatcaggcactaaattaaatagctttgcacaaaattttagaaaagatcaatcttgtaacaaaatttaatattaacagtaaaaagcacctgagaaaagaaaatatcgatctgttgtggtttatatacttgagttattcttagaactttgtggagattgacactgctctgataaaaaggaagaaaatgttttgaattcaagaatgctagactaatagaaatagcccagtctctctgggccactgctcttcagtatggggtgctctctgtccctccttagcagatggggttgtttggaggctaaaatgagctaagggaagaagctatactgtgcctccaatatcccttatgtgtaattagagtgccgatctgggctgcaggctttattcaatgattcctttcccttacttgaggctttctctgtagagctgttatttctgagcctccattctgggatttacaaaggaaacagaatgatgaagaagtaacaatcagcattttacacacacgcacacacacacacacacacacactttttctaatatatgaggctagtctgcagagtccacagcccaggtgtccatttatttccacttcttcacctcccaaagatttagagctccatgatctaccaaggtgaagactgccaatcccaggttggagaagacccgtcagagtgtggaggtgccaaactgagaggcacaggaagcagacagccacatcaaacttttttgatgaactactgcaaattggtgtttgttctaggaaagaaagaggaagaaaaattacacaatgtgaattgaacataagagcagtgctctttacagagtatgagaagggaggatgggggagaatctgattaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttctttttttttttttttttttttttcctctgtgcatcctagaaaaactcccaggactagacttaggaggaggcaatcaagttatgtggtaaaacaagagtgccttttctgttggatatccactttagtttcctggcttccagggcataagatgtttagaaactttttttctctaaacataagaattattgtgtaccacaattttgaaccaccgatttccatatcttcagcagctatcaacttgccaattccctttgggtctcctttgtatattcttatgtttccttctgtttccagttgtcctcaaaaagagttgaggggggcatgactcttataaaatggataaaaatgaaactgtacagatgtttgcctcccttgtatctgtgagcatgatctctatcaggctggaaaatctgctttatcattttgtatatttgactattttgtattcagcattacttgactccttatgtgcatggcaatgtattaaaatgtgggatttctattaccgtgt

SEQ ID NO: 18375 - DNA, 7134 bp, Homo sapiens
  ENST00000318238
gaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttgggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattgttttatgcaatacgttctcaacaagtatatcctccggcaaactgaacaaggaccaagtctgttctgcctacagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaattgcttttataagttttctaaattatttcttcactgtgacagcaaagatttaaataagatgaatgtaaaagagaaagcttattggactcaaacccacagatccacaccagagttctatttacctcatcttggtatcaataaaaacttatgtggaaggtaaatatattgttccccatccaccacataacactctccccaacacacacacacacacacacacacacacacacacacacacacactccttgtaccccttgcccttctcccagctcattgctccaggagagagaagagttcaaaaaataaagtaatcataaacttgaactctctccattctcttgttcccatttacaggtgaatctcttcctttaagccatttttgtctcctgtgaatacagccttatctccacctgtttcttagatcccatctcccctggcttattttttccattcattaccctctttgttccctttacttctcaacctgtgctatatacatgctgttctctctgttgagattgccttatttccatctaacattctctctcctgctattctgatttgtcattcacaactgatttcaagagtcaccttcaccaggaagtcttccttgaccaccatcattcctgcctgattagagggcttcctcatggtaatatgtgttctcaagttttcagtgtcaaggaatgccatcccagaagctcattctcagatgcacaacagccagaacagtctcaagcagcattctagagcttggaatttaagaactacgcattgcctataaagtgaaacataggctaatatagattaaattgaatattgaataaaaaatatatttatttatccac

SEQ ID NO: 18376 - DNA, 5831 bp, Homo sapiens
  ENST00000411955
tgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaattgcttttataagttttctaaattatttcttcactgtgacagcaaagatttaaataagatgaatgtaaaagagaaagcttattggactcaaacccacagatccacaccagagttctatttacctcatcttggtatcaata

SEQ ID NO: 18377 - DNA, 5757 bp, Homo sapiens
  ENST00000437805
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttgggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttgg

SEQ ID NO: 18378 - DNA, 763 bp, Homo sapiens
  ENST00000446959
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 18379 - DNA, 631 bp, Homo sapiens
  ENST00000439952
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 18380 - DNA, 381 bp, Homo sapiens
  ENST00000414791
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 18381 - DNA, 1198 bp, Homo sapiens
  ENST00000446033
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattgttttatgcaatacgttctcaacaagtatatcctccggcaaactgaacaaggaccaagtctgttctgcctacagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 18382 - DNA, 611 bp, Homo sapiens
  ENST00000477816
agaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattg

SEQ ID NO: 18383 - DNA, 1221 bp, Homo sapiens
  ENST00000610760
atgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaa

SEQ ID NO: 18384 - DNA, 3848 bp, Homo sapiens
  ENST00000409687
gccgcgaggagggccccattcaaaagtagtcgctattgtcgccgtgggctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggcggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgcagtggcgtgcagggccctggaggcggactcaggggatgcccggcgggctccccgtgcccgaggggaacgtcggaggcacaccatcgccagcggcgtggactgcggcctgctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgactttggggctgcagggagcccccgcccactggggcggctactgcccaaggtacaagaggtggcccggtgcctgggggagctgctggctgcagcctgtgccagccgggccctgcccccgtcctcctccgggcccccctgccctgccctgacgtccacctcacccccggtctggcagcagcagaccatcctcatgctgaaggagcagaaccgactcctcacccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatgaacaa

SEQ ID NO: 18385 - DNA, 801 bp, Homo sapiens
  ENST00000379251
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatg

SEQ ID NO: 18386 - DNA, 909 bp, Homo sapiens
  ENST00000379253
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtc

SEQ ID NO: 18387 - DNA, 868 bp, Homo sapiens
  ENST00000379254
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaa

SEQ ID NO: 18388 - DNA, 1065 bp, Homo sapiens
  ENST00000379270
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagca

SEQ ID NO: 18389 - DNA, 1135 bp, Homo sapiens
  ENST00000489394
ctggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggttacagtctctagcttcgccatgtacatggcccttccgtgtacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 18390 - DNA, 735 bp, Homo sapiens
  ENST00000463236
aagcaaaagacgaaaatggctaaattcgtgatccgcccagccactgccgccgactgcagtgacatactgcggctgatcaaggagctggctaaatatgaatacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaa

SEQ ID NO: 18391 - DNA, 432 bp, Homo sapiens
  ENST00000487713
ggtgtgagagcccagcctgttcccctttctgcgcccatccccggctcggccgccaccccgcccgcccgccccattccgttcccctgagctggccgggccggagcctcattttgttttctacttttttctctcctatgtgcatccccccaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgagg

SEQ ID NO: 18392 - DNA, 1033 bp, Homo sapiens
  ENST00000474223
gggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaa

SEQ ID NO: 18393 - DNA, 826 bp, Homo sapiens
  ENST00000462639
gattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 18394 - DNA, 1631 bp, Homo sapiens
  ENST00000246868
gtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagacaa

SEQ ID NO: 18395 - DNA, 1531 bp, Homo sapiens
  ENST00000414306
tgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagc

SEQ ID NO: 18396 - DNA, 841 bp, Homo sapiens
  ENST00000490953
ctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtaagagtcaaatattttctttgcttcatgttacctaaatattgtattctctagtaataaatttgtagcaaacatt

SEQ ID NO: 18397 - DNA, 513 bp, Homo sapiens
  ENST00000463579
ggactttctctcctgccctcacaagggaaaaagacctcgatgaagttctgcagacccactcagtgtttgtaaatgtttctaaaggtcaggttgccaaaaaggaagatctcatcagtgcgtttggaacagatgaccaaactgaaatctattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatc

SEQ ID NO: 18398 - DNA, 953 bp, Homo sapiens
  ENST00000617799
cagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcgcgtgggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacac

SEQ ID NO: 18399 - DNA, 4923 bp, Homo sapiens
  ENST00000361757
gtgcgcggggcccccaagatggcgcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttcc

SEQ ID NO: 18400 - DNA, 4537 bp, Homo sapiens
  ENST00000438103
aatgctggggctgctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttc

SEQ ID NO: 18401 - DNA, 4861 bp, Homo sapiens
  ENST00000587024
gaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgccta

SEQ ID NO: 18402 - DNA, 1209 bp, Homo sapiens
  ENST00000587673
cgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtggggtcgggcggggttacccccccagaggagggcccgcggggggcggaccggggcgcggcctcaacgcccccctccgcaggtccgcggtaacaagcccagctgcctgctggcggagcagaaccgcggccagttcttcacggtgtacaagcccaacatcggccggcagagccagctggaggccctggacagcctccgccgcaagttccaccgggtaggcggccgccgggcgcagctttcgctcgggttgccggccctgaccccgcccaggctcatgcggccctgtgtccctaggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggc

SEQ ID NO: 18403 - DNA, 465 bp, Homo sapiens
  ENST00000586109
tggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaaggtcagcaggaagccccacagcccctcacactctgcccaccccgcccccaccacactcacacccccccaccccgtgccgtggcagatcagcgtggaccgcggcctgaagtgggaggacgcctttgccaagtcgctggcgctgacgggcccctatgacggcttctacctctcctacaaggtggg

SEQ ID NO: 18404 - DNA, 2403 bp, Homo sapiens
  ENST00000592222
aatgctggggctgctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacgtaagccctgccccccatggccccacccacccctgcccctctgctttctccccccgggggctggctggtcgctccctgcttcccccactcccccgtccactcagccaaatgcaggtcctgtccgtgccaggcaggctcaaggctccgctgccagtggcaggtcttgcgtggaccctgccatggaacgcttagggaagaggaagcaacagacagcctgaaggacacagacgtgggtgccgagcgagacccggggggcgggacacggacgcgggtgctgagcgagacccctcccaccttccgttttcagggtctccacggtcccttggggagcccattgataacccccaggcttctgtcacagggaagcccagagctgcctgtcgaagtctggtgtgtggcctccccaggcaccccgcgtgtccaccatactggccaggcctgaaaggacgttggatatgggtttattaatattgtcccgttggctgggcgtggtggctcacgcctgtaatcccagcactttgggaggccgaggcgggtggatcacctgaggtcaggagtttaagaccagcctggccaacatggtgagaccctgtctctactaaaaatacaaaaattagctgggcgtggtggtggacgcctataatcccagctacttgggaggctga

SEQ ID NO: 18405 - DNA, 587 bp, Homo sapiens
  ENST00000590446
ggcgtttgccccccaccaggaaggtggggtcttgggtggtcaggacctgggctcctggggtcgcccccgtccttcagaatactccttaacccacgtgtgcctcagatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttctt

SEQ ID NO: 18406 - DNA, 562 bp, Homo sapiens
  ENST00000590998
ggaaagctttccctgccaccacgggccagcctgggtccctgcactcgccagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcc

SEQ ID NO: 18407 - DNA, 561 bp, Homo sapiens
  ENST00000590176
actcatcggtgcccccgagccccttggtgaccccgcacccgcttttcctcgatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagc

SEQ ID NO: 18408 - DNA, 914 bp, Homo sapiens
  ENST00000587655
gcagatcggactggcgggcctggtgccgctgtctcagtgacctgctttgtgactcgtgcccgtgcttcccggagccttgtgattgacctccatccccagcaagaacaagcgtccaagtgaaaccgaaagaggcggccttggccttggttccaggccccgctgcgttttgaaagtgatgtgcgccaggttccggaaggcggctcactcgcgtttcctgggagtctctgccgctgtgggctcctggggccaaggccctgggtgctggggcgtggggagggggagccggtgagccttcgggcctggcgggcagtaaacgtttctggaactgactcacttgctggggaggggcagccagggagggtcacggagaaagtccctgcccgccatggccccggaccgccgtcggctgcccgtccagcctggagtgaggaggcgtcttcctttgcatgtcagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtgga

SEQ ID NO: 18409 - DNA, 4811 bp, Homo sapiens
  ENST00000631948
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttcc

SEQ ID NO: 18410 - DNA, 4537 bp, Homo sapiens; identical to SEQ ID NO: 18400
  ENST00000622719

SEQ ID NO: 18411 - DNA, 4776 bp, Homo sapiens
  ENST00000634172
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgccta

SEQ ID NO: 18412 - DNA, 1209 bp, Homo sapiens; identical to SEQ ID NO: 18402
  ENST00000631689

SEQ ID NO: 18413 - DNA, 465 bp, Homo sapiens; identical to SEQ ID NO: 18403
  ENST00000632999

SEQ ID NO: 18414 - DNA, 2403 bp, Homo sapiens; identical to SEQ ID NO: 18404
  ENST00000631752

SEQ ID NO: 18415 - DNA, 587 bp, Homo sapiens; identical to SEQ ID NO: 18405
  ENST00000631951

SEQ ID NO: 18416 - DNA, 562 bp, Homo sapiens; identical to SEQ ID NO: 18406
  ENST00000632777

SEQ ID NO: 18417 - DNA, 510 bp, Homo sapiens
  ENST00000633604
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagc

SEQ ID NO: 18418 - DNA, 461 bp, Homo sapiens
  ENST00000631778
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtgga

SEQ ID NO: 18419 - DNA, 4686 bp, Homo sapiens
  ENST00000612198
atgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttccc

SEQ ID NO: 18420 - DNA, 1142 bp, Homo sapiens
  ENST00000568423
gctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgtggggaagcgggcgtgacctcttctgaaaaggcgttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtg

SEQ ID NO: 18421 - DNA, 3411 bp, Homo sapiens
  ENST00000425597
ggcctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgt

SEQ ID NO: 18422 - DNA, 579 bp, Homo sapiens
  ENST00000562327
gcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagaaccccgaccaagaacagatgccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttgg

SEQ ID NO: 18423 - DNA, 600 bp, Homo sapiens
  ENST00000568018
gcgcgctccccgcccccagccccggagcggctcgcggccggctccgcgccgcatcgctcgggtgcagcgcagctcagcgcagcgctgcggcctttcggcagccgaacggccgcggcagacggagtcttgctctgtcgccgggctggagggcagtggcacgatctcggctcactgcaacctctgcctcccaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaa

SEQ ID NO: 18424 - DNA, 3400 bp, Homo sapiens
  ENST00000562212
cccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgccccacactggcctcttcctgcagcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctg

SEQ ID NO: 18425 - DNA, 590 bp, Homo sapiens
  ENST00000565923
cccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaaggcttgggggccttgaaggcagggaagccctggccctctgcccaggtgacgggagccacctcctctgccgcaggactgacagctccttcagtttcatggcattcttctttaccttcatggctcagttggtcatcagcatcatcca

SEQ ID NO: 18426 - DNA, 588 bp, Homo sapiens
  ENST00000567920
agccccggagcggctcgcggccggctccgcgccgcatcgctcgggtgcagcgcagctcagcgcagcgctgcggcctttcggcagccgaacggccgcggcaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgt

SEQ ID NO: 18427 - DNA, 1206 bp, Homo sapiens
  ENST00000562765
agccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtggg

SEQ ID NO: 18428 - DNA, 593 bp, Homo sapiens
  ENST00000567535
ggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttccccttt

SEQ ID NO: 18429 - DNA, 561 bp, Homo sapiens
  ENST00000566872
tccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaagg

SEQ ID NO: 18430 - DNA, 532 bp, Homo sapiens
  ENST00000564491
tccgcgccgcatcgctcgggtgcagcgcagctcagcgcagcgctgcggcctttcggcagccgaacggccgcggcagaaccccgaccaagaacagatgccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggt

SEQ ID NO: 18431 - DNA, 3427 bp, Homo sapiens
  ENST00000361900
tccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 18432 - DNA, 554 bp, Homo sapiens
  ENST00000564141
agcctgagctttgggccctccatcccccccgccagccccacctggcgttccctggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtgttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccg

SEQ ID NO: 18433 - DNA, 557 bp, Homo sapiens
  ENST00000568119
ggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgtga

SEQ ID NO: 18434 - DNA, 554 bp, Homo sapiens
  ENST00000565989
aaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccacca

SEQ ID NO: 18435 - DNA, 516 bp, Homo sapiens
  ENST00000564779
attgcattcacggcactgtgggattcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcgg

SEQ ID NO: 18436 - DNA, 966 bp, Homo sapiens
  ENST00000567529
tgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgccccacactggcctcttcctgcagcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctct

SEQ ID NO: 18437 - DNA, 710 bp, Homo sapiens
  ENST00000568081
ggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttacc

SEQ ID NO: 18438 - DNA, 1910 bp, Homo sapiens
  ENST00000337221
gggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccgcgcgccggagcatgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatggtaagcatcaccttaagcacatattatgccttgagacactagccaattgtggtacatgaaaataatttataaataaataaatttacctatattaggaagatga

SEQ ID NO: 18439 - DNA, 3510 bp, Homo sapiens
  ENST00000301904
aggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagt

SEQ ID NO: 18440 - DNA, 2269 bp, Homo sapiens
  ENST00000471491
cactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaagggtaagtcaatctcctaccttgatggagctctttttattcaggttagcttttttacctcattaggaatgggagtgttatgctttcctttgtggcagtgaactcttgtactgctttgacccatcagacctagtaggcaaaaggaatatgttgagtgctgtttcataggacctctgatttgagttacattgaagtaggtgcaggaaaacctgctacataatctcttattccgtattttcttaaataattaagagatgagtcaaattttaatttaaattaagaaatataaaggacaaaattgcacagcgagagccacattgagaagcctttctaaactgatttagacacatttaaatgaaatgctattgtggaaattactaaaggtaagttaaggataattacatcaaagctctttttggtcatttggtcctgaaaacacctgacaccacattcagggacattcttgattatacagatttcagagaaaattgtactgtaacctaactgacaagttttggtgttttttccaaagaagacaaaatctcgaatctgttgctaaagtgaatgccaggatgaataaaacgagcagaaggtgagaactgaacagatgtctctaaatattggttattttctctcatattaattatgtgatattgagggcaccacatctttgtttggcttctctcttctgtgtctaatccctggtgccctgatcttcacttcaaagaatctacagtatattcgatctaaatttacatttacatatagcccaataaaatcctaaggattaattaaactatgttattgattggcaatttttatacttaaagccaatttaatgtcagtataataattttctccaaaagcttgaattaatcattgggaatacagaagatgtatgtgtctaatattatgggaatgttttgaaactgatataaacttttttttttaaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaa

SEQ ID NO: 18441 - DNA, 3081 bp, Homo sapiens
  ENST00000377246
cagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaa

SEQ ID NO: 18442 - DNA, 2386 bp, Homo sapiens
  ENST00000349847
agatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccaga

SEQ ID NO: 18443 - DNA, 590 bp, Homo sapiens
  ENST00000469982
gaacaaatgttttctagaagctacgtgtgcaagtacattgcacaatgctgtaattaatcagtgtacctatgtgtggactcaattaaaatgaagaattggataatctcatcaaaatgaacaaaagcttgaatagagccaaaagccttgaaagtctcatctatatgagtacccggacagataaagatggcaaaggaatccaaagccttggaagtccgattaaagttaatcaaaggactgacaaaaatgagaaagggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaatt

SEQ ID NO: 18444 - DNA, 3096 bp, Homo sapiens
  ENST00000535157
aagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagagggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacat

SEQ ID NO: 18445 - DNA, 3315 bp, Homo sapiens
  ENST00000220478
gttccattcccgggggattggagtagcgttggagtcaccgacgccatcccctcccgcctctggcgtgcatggagcatgcgcttccttcctcacttcctctgcaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcactctt

SEQ ID NO: 18446 - DNA, 2163 bp, Homo sapiens
  ENST00000542355
gtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgac

SEQ ID NO: 18447 - DNA, 896 bp, Homo sapiens
  ENST00000558709
agcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcag

SEQ ID NO: 18448 - DNA, 1447 bp, Homo sapiens
  ENST00000377961
cagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattggaaacaaaaa

SEQ ID NO: 18449 - DNA, 1402 bp, Homo sapiens
  ENST00000612225
cagccgctggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatggacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattgg

SEQ ID NO: 18450 - DNA, 704 bp, Homo sapiens
  ENST00000334979
atggacagctcccgggaaccgactctggggcgcttggacgccgctggcttctggcaggtctggcagcgctttgatgcggatggacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataa

SEQ ID NO: 18451 - DNA, 1436 bp, Homo sapiens
  ENST00000629145
gcttttatgagctgtaacactcaccgcgaaggtccgcagcttcactcctgaagccagcgagaccacgagcctactgggaggaacgaacaactcccgacgcgccgccttaagagctgtaacactcaccgcgaaggtctgcagcttcactcctgagccagcgagaccacgaacccaccagaaggaaaaaactccgaacacatctgaacatcagaagcaacaaactccggacacgccgcctttaagaactgtaacactcactgcgagggtccgcggcttcattcttgaagtgagtgagaccaagaacccaccagttctggacacaatttcaagtcctcaggtgccatcaatattctgaaaatggcagtgatttttattcaacctgtataaggcactttcaccatgtacctggaagcaacatctacatctttttcagcaatctagatgctggggacacaaggtccaccttccaggaatatggccatgacaccagaaatcacaaacatgatgagaatggaatgactggggaagaagtgccagatgcttcacttgtaaatgaagacccagcctctggggatgcagataccacctccctgaagaagctgaatatctgcagataagtggagttcaccaatgatgaggagcgggatggagaaaggaggtagggagagtcatccaaggaacatgagcaacatgttaaaagccaagtggtttaatttctggagatggtgaacccaagaggctctgctgggagacaacaaaaataatgaagaattgaaccagagtccggtgaatatcagcactgggaccagttagcagaggaaaaggaaagaataaaagcgaaaagaatgaagagtcatatgattaccaacttttcctttttcatataaattgagtgtatatgggtctggaacaacctgaatttccatcaagtcctggctaacctcattatgtcctatgaatatttttgactaatcccactttacattaatctgtattgtgaatgtggatattgaattatatttctttgtaatcccattatccaaaatccagttcagagactattagttaccaatgttcactgtgaaggaaaaaaaaaaaaaaaaagctcagaggataaacatgtgatatggtttggctgtgtccccacccaaatatcatcttgaattgtagctcccataattcccacgtgttgtgggagggacccggtgggagataattgtatcatgggggtggttcccccatactattctcatagtagtgaataagtctcacaaaatctgatggttttatgagggaaaacccctttcacctggttctcattctcttctctggtctgtcgtcatgtaagacatgcctttcaccttctccaccatgactgtgaggcctccccagccacgtggaactgtgagcccattaaacctctttcacttataaat

SEQ ID NO: 18452 - DNA, 12903 bp, Homo sapiens
  ENST00000641996
tactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcctacattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttattttattgtttgcccagtcactttttgttaacagaatattctaatgatatggagattttttacattacaaattgggggagaaggggagcgcgcgcgcacacacacacacacacacacacacacacacacacacacagaggcatacccacgttgacaacaaaacctagggtagatatgtcactggaggtagggggtaatgacctcccagaattacaagcagcaggtgtgttctctgttaggaggaagaactggtgtcagaggatagctagtgattctaggaggaagagaagtatggaagccagagtgatggtggatgaccccttgagctatgaaaagaaacccttaaatcatcatttaaaaatttagaattgccatgtgtgtaggatactgtgtttgctcctccagagccactctctctgcttctgcatcattctgtgtgtcccagaagggtgacttctacacattgcaaaaatgggctctcctacctttgagctcccaattggtttggccaatgagaagcaccagtgggaaagcaccagagagagaagattgacataggaatatttcttctccaattccttctttgctgggttggcactggactcattcctccccgaaaagtcatactccaatcagactgcccctcatacaactgaagctactttctctggggtcaggtaatcactcctccccttgctccttcaggtctgctgctgcattgagagtgcttttgtattccttgtagctttctcctaacattgctgacacttttgtaaatgtccccttcatgaaattcttctatatgcctcatttcagcatgccatctgtctcctgcctggctgacacaaggtgattcaacagctcatgaaagtcagcaggaagcaaagatgtgccttgcttcagcttggggtcttaatcttgctaacttttgcagataaagaaaaacagtaactgggggaaccacagtgaagtccagtgcagaattcacagatatcatggaaaggttactcgggtggtccagatagtaaaattaacagtctaaattaatctatctaaatttctgaggaacgagaagccttcccttgtcatcaggtgaagccagaagagggaatatagcctcaaccagaaaagggacagtaattaaaaggcttttcccatccttgtacaatggactgactttgcctcttcataacatcacaatcctaaagcaacacaacaattaattctgatatattagtagctgaaaaaaattcccatttccaactaaggtaggtcagaattataggataaaccctgcagactttttatactacccatccacgccattactcactgttacctttccaaatacaaagagaagaactggtaaaacataatcatataaatctccatattcattttgaaatatttggcatgatattttctgtgctaaaaagtaattattcttcaaagaatgatgaggtcatgtcagtaagacacaggaaccaactagaaggggcttcccactggccaaatctggggcaagttgagcatcaaaataaatgatagtaaaagattataattcattgaataagaatcagcaaatacatactgatgtaagtaaataaggaaaagtacaaatctgtttcttgcagttgaatgttaattaacaattgtagaagaaataacggagttagaaaaatcactatttggcaatcaccctaatgacaattgattcatacaagaatcatcaatgagtattaaaactcatgggtgaaagtttgatgaggaatagggtatttatagcatcttaaagtatctcttctctattaagtagaaaatttaaacagaagaaagtatactttggagaaatacagcagacaataccttcaaagatatcatcaattatgagaccaactgatactatgtgcctcctgataagatatactgaaagggccacattacttcttggtacacagtcaaaattttaaaaccagaatctaactacaaggaaaatcaaattgaggacactctataaaataagtggactgaactccttaaaaatgtcaatgtcatgaaagacaaagaaaggctaaagaattccatgaggtcaaagaactatgacaactaaacacaattctggatggaatatcaaattaaaaaataacagataaataatattattgggaaagttgaataaatttgaatatggactgtttattagttattagtattataatagtgttaattttcctaattttgttaagactagtgtgcctgttccatgaaaatagaaaatgttcttattctctgaaaatgcatgctaaagtatttaggggtgaatgcaacaatgtctgcagctcattcttgaatcagttcaaagaaaaatgagttacatttatatatatatgtatgtatgtaaacagacatagataaaagtatagatgtgtgtgtgtctttagaaaggggaggattttttttttttttttgctgtgtgttactgaagtgcctatgtctgcgtgttcacactatcatattttgtatgccctggactttataatttctaccttcaaaattagatctactgttggtaattaattcaatatatactggttttttaactactattctcatttcctagcagtaatcttcctgaaaagtcacagaaatgattacattccttgttcttcataataatcactgtttaattaaaataagaatattttagaaaagatctgcggcatagtggttaagaccccagtatttgatgctaaacagatctgatttggataacagaaggtggcactttgctgtttaagctggggaccagacactgtgggtataaatagtaattccaaacacagctccacagagcagcacccttatgacaaggttttcatatgtctatagttaagccagaaaattaagaataatgccataaatatttataaagctgaacatatccaagttaaagacctttatcctgaaattgtatcttttagattattttctaaagactaataccatttaatgtttaaatgttctttggaaatgatggtgagaatacgtgataatgggtcattggttttaatattttatttagccaagtggaaaattggcaacctggtgtcggtcctcccatttgtattttactggtgcatgaaatccaaaagtctagtaaccattgggacagacaactctactgcataagtttgtatgtttgtatatctgtatcacaaagcccagacactcgaactatataaacttgtcgcactaaagacagcaaatatgtctggtaattgcatattcttcatgtgtgcactggaatttcttattatataagaaaataaatgtgtttctaaaccaccatgaattgggtactgctgatagtactattcttcctggcacatggaaatatcccactgaggttgtcaatcaatattgatttaatcagtgtggcagcaaaggcactagaggaggaaaatactctagacaatcaagtatagatgggaaaattgcatcaccaagaaattcttaaaatcacaagtggataatttgcaatatcaattgattttactcaactgcttgagtcctttatcattccgttagaacactcctcatatttgcagataactcagcccctcacctcagcaacaagcaagaggacatcattataaacttcctcaatttctttcctatccagtgaaaaatatctaagtcccttttcccttcccttttccttcccttcccttcctttttctttccttccattctcttcctttttccttcctttttctttccttccattctcttcctttttccttcctttttcttactttacctccccctcctacctttccctttctcccttcctccctctctcccttccttcctctctccctctccttccttccttccttcaatccatacttttatatcttttcagagatcaatttttcccattcatttctacattctcagataccttgctccatgacttgttctacttctcttctatctttattctttccctcttgactgatcctttttgtctgcctttgcattttcaaaatcagtttttctaatcttaaaaaataactttgctcaaccctgatgcatctttattcactgtgtcattatctcattatttttaaaggttagtttctaaagccagggctctatactcactaccttcactcttggttaaaattaaaagaaatataggtcccagtgatatttatgggaaaatttgactgtgaataatcttgttgatataaacactttgggttttcaaaatgttatgctagctgttaactttcccagtaacattatgagggaagggctggaaaatacaaaaggtagacataggaaccgagaacaccacccctatggagccaagctatacatactctgtctctggttatcataaatacatctcctatattcaatgcttgcttagaaaggcatgatgtccacggagcaattcaattgttcactgtgatgggtttttttgttttctcctcatggaatgcaacttttatttat

SEQ ID NO: 18453 - DNA, 12874 bp, Homo sapiens
  ENST00000641575
gtggaaactcatggaactgttcctccagattaacacttcaggggttatggaagctggaggaagctgagcttttactacatcttttgggggttatttatccattcacctactgaaggacatcttggttgcttccaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttattttattgtttgcccagtcactttttgttaacagaatattctaatgatatggagattttttacattacaaattgggggagaaggggagcgcgcgcgcacacacacacacacacacacacacacacacacacacacagaggcatacccacgttgacaacaaaacctagggtagatatgtcactggaggtagggggtaatgacctcccagaattacaagcagcaggtgtgttctctgttaggaggaagaactggtgtcagaggatagctagtgattctaggaggaagagaagtatggaagccagagtgatggtggatgaccccttgagctatgaaaagaaacccttaaatcatcatttaaaaatttagaattgccatgtgtgtaggatactgtgtttgctcctccagagccactctctctgcttctgcatcattctgtgtgtcccagaagggtgacttctacacattgcaaaaatgggctctcctacctttgagctcccaattggtttggccaatgagaagcaccagtgggaaagcaccagagagagaagattgacataggaatatttcttctccaattccttctttgctgggttggcactggactcattcctccccgaaaagtcatactccaatcagactgcccctcatacaactgaagctactttctctggggtcaggtaatcactcctccccttgctccttcaggtctgctgctgcattgagagtgcttttgtattccttgtagctttctcctaacattgctgacacttttgtaaatgtccccttcatgaaattcttctatatgcctcatttcagcatgccatctgtctcctgcctggctgacacaaggtgattcaacagctcatgaaagtcagcaggaagcaaagatgtgccttgcttcagcttggggtcttaatcttgctaacttttgcagataaagaaaaacagtaactgggggaaccacagtgaagtccagtgcagaattcacagatatcatggaaaggttactcgggtggtccagatagtaaaattaacagtctaaattaatctatctaaatttctgaggaacgagaagccttcccttgtcatcaggtgaagccagaagagggaatatagcctcaaccagaaaagggacagtaattaaaaggcttttcccatccttgtacaatggactgactttgcctcttcataacatcacaatcctaaagcaacacaacaattaattctgatatattagtagctgaaaaaaattcccatttccaactaaggtaggtcagaattataggataaaccctgcagactttttatactacccatccacgccattactcactgttacctttccaaatacaaagagaagaactggtaaaacataatcatataaatctccatattcattttgaaatatttggcatgatattttctgtgctaaaaagtaattattcttcaaagaatgatgaggtcatgtcagtaagacacaggaaccaactagaaggggcttcccactggccaaatctggggcaagttgagcatcaaaataaatgatagtaaaagattataattcattgaataagaatcagcaaatacatactgatgtaagtaaataaggaaaagtacaaatctgtttcttgcagttgaatgttaattaacaattgtagaagaaataacggagttagaaaaatcactatttggcaatcaccctaatgacaattgattcatacaagaatcatcaatgagtattaaaactcatgggtgaaagtttgatgaggaatagggtatttatagcatcttaaagtatctcttctctattaagtagaaaatttaaacagaagaaagtatactttggagaaatacagcagacaataccttcaaagatatcatcaattatgagaccaactgatactatgtgcctcctgataagatatactgaaagggccacattacttcttggtacacagtcaaaattttaaaaccagaatctaactacaaggaaaatcaaattgaggacactctataaaataagtggactgaactccttaaaaatgtcaatgtcatgaaagacaaagaaaggctaaagaattccatgaggtcaaagaactatgacaactaaacacaattctggatggaatatcaaattaaaaaataacagataaataatattattgggaaagttgaataaatttgaatatggactgtttattagttattagtattataatagtgttaattttcctaattttgttaagactagtgtgcctgttccatgaaaatagaaaatgttcttattctctgaaaatgcatgctaaagtatttaggggtgaatgcaacaatgtctgcagctcattcttgaatcagttcaaagaaaaatgagttacatttatatatatatgtatgtatgtaaacagacatagataaaagtatagatgtgtgtgtgtctttagaaaggggaggattttttttttttttttgctgtgtgttactgaagtgcctatgtctgcgtgttcacactatcatattttgtatgccctggactttataatttctaccttcaaaattagatctactgttggtaattaattcaatatatactggttttttaactactattctcatttcctagcagtaatcttcctgaaaagtcacagaaatgattacattccttgttcttcataataatcactgtttaattaaaataagaatattttagaaaagatctgcggcatagtggttaagaccccagtatttgatgctaaacagatctgatttggataacagaaggtggcactttgctgtttaagctggggaccagacactgtgggtataaatagtaattccaaacacagctccacagagcagcacccttatgacaaggttttcatatgtctatagttaagccagaaaattaagaataatgccataaatatttataaagctgaacatatccaagttaaagacctttatcctgaaattgtatcttttagattattttctaaagactaataccatttaatgtttaaatgttctttggaaatgatggtgagaatacgtgataatgggtcattggttttaatattttatttagccaagtggaaaattggcaacctggtgtcggtcctcccatttgtattttactggtgcatgaaatccaaaagtctagtaaccattgggacagacaactctactgcataagtttgtatgtttgtatatctgtatcacaaagcccagacactcgaactatataaacttgtcgcactaaagacagcaaatatgtctggtaattgcatattcttcatgtgtgcactggaatttcttattatataagaaaataaatgtgtttctaaaccaccatgaattgggtactgctgatagtactattcttcctggcacatggaaatatcccactgaggttgtcaatcaatattgatttaatcagtgtggcagcaaaggcactagaggaggaaaatactctagacaatcaagtatagatgggaaaattgcatcaccaagaaattcttaaaatcacaagtggataatttgcaatatcaattgattttactcaactgcttgagtcctttatcattccgttagaacactcctcatatttgcagataactcagcccctcacctcagcaacaagcaagaggacatcattataaacttcctcaatttctttcctatccagtgaaaaatatctaagtcccttttcccttcccttttccttcccttcccttcctttttctttccttccattctcttcctttttccttcctttttctttccttccattctcttcctttttccttcctttttcttactttacctccccctcctacctttccctttctcccttcctccctctctcccttccttcctctctccctctccttccttccttccttcaatccatacttttatatcttttcagagatcaatttttcccattcatttctacattctcagataccttgctccatgacttgttctacttctcttctatctttattctttccctcttgactgatcctttttgtctgcctttgcattttcaaaatcagtttttctaatcttaaaaaataactttgctcaaccctgatgcatctttattcactgtgtcattatctcattatttttaaaggttagtttctaaagccagggctctatactcactaccttcactcttggttaaaattaaaagaaatataggtcccagtgatatttatgggaaaatttgactgtgaataatcttgttgatataaacactttgggttttcaaaatgttatgctagctgttaactttcccagtaacattatgagggaagggctggaaaatacaaaaggtagacataggaaccgagaacaccacccctatggagccaagctatacatactctgtctctggttatcataaatacatctcctatattcaatgcttgcttagaaaggcatgatgtccacggagcaattcaattgttcactgtgatgggtttttttgttttctcctcatggaatgcaacttttatttat

SEQ ID NO: 18454 - DNA, 12506 bp, Homo sapiens
  ENST00000641603
gacacactgctggcctgtggaaactcatggaactgttcctccagattaacacttcaggggttatggaagctggaggaagctgagcttttactacatcttttgggggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttattttattgtttgcccagtcactttttgttaacagaatattctaatgatatggagattttttacattacaaattgggggagaaggggagcgcgcgcgcacacacacacacacacacacacacacacacacacacacagaggcatacccacgttgacaacaaaacctagggtagatatgtcactggaggtagggggtaatgacctcccagaattacaagcagcaggtgtgttctctgttaggaggaagaactggtgtcagaggatagctagtgattctaggaggaagagaagtatggaagccagagtgatggtggatgaccccttgagctatgaaaagaaacccttaaatcatcatttaaaaatttagaattgccatgtgtgtaggatactgtgtttgctcctccagagccactctctctgcttctgcatcattctgtgtgtcccagaagggtgacttctacacattgcaaaaatgggctctcctacctttgagctcccaattggtttggccaatgagaagcaccagtgggaaagcaccagagagagaagattgacataggaatatttcttctccaattccttctttgctgggttggcactggactcattcctccccgaaaagtcatactccaatcagactgcccctcatacaactgaagctactttctctggggtcaggtaatcactcctccccttgctccttcaggtctgctgctgcattgagagtgcttttgtattccttgtagctttctcctaacattgctgacacttttgtaaatgtccccttcatgaaattcttctatatgcctcatttcagcatgccatctgtctcctgcctggctgacacaaggtgattcaacagctcatgaaagtcagcaggaagcaaagatgtgccttgcttcagcttggggtcttaatcttgctaacttttgcagataaagaaaaacagtaactgggggaaccacagtgaagtccagtgcagaattcacagatatcatggaaaggttactcgggtggtccagatagtaaaattaacagtctaaattaatctatctaaatttctgaggaacgagaagccttcccttgtcatcaggtgaagccagaagagggaatatagcctcaaccagaaaagggacagtaattaaaaggcttttcccatccttgtacaatggactgactttgcctcttcataacatcacaatcctaaagcaacacaacaattaattctgatatattagtagctgaaaaaaattcccatttccaactaaggtaggtcagaattataggataaaccctgcagactttttatactacccatccacgccattactcactgttacctttccaaatacaaagagaagaactggtaaaacataatcatataaatctccatattcattttgaaatatttggcatgatattttctgtgctaaaaagtaattattcttcaaagaatgatgaggtcatgtcagtaagacacaggaaccaactagaaggggcttcccactggccaaatctggggcaagttgagcatcaaaataaatgatagtaaaagattataattcattgaataagaatcagcaaatacatactgatgtaagtaaataaggaaaagtacaaatctgtttcttgcagttgaatgttaattaacaattgtagaagaaataacggagttagaaaaatcactatttggcaatcaccctaatgacaattgattcatacaagaatcatcaatgagtattaaaactcatgggtgaaagtttgatgaggaatagggtatttatagcatcttaaagtatctcttctctattaagtagaaaatttaaacagaagaaagtatactttggagaaatacagcagacaataccttcaaagatatcatcaattatgagaccaactgatactatgtgcctcctgataagatatactgaaagggccacattacttcttggtacacagtcaaaattttaaaaccagaatctaactacaaggaaaatcaaattgaggacactctataaaataagtggactgaactccttaaaaatgtcaatgtcatgaaagacaaagaaaggctaaagaattccatgaggtcaaagaactatgacaactaaacacaattctggatggaatatcaaattaaaaaataacagataaataatattattgggaaagttgaataaatttgaatatggactgtttattagttattagtattataatagtgttaattttcctaattttgttaagactagtgtgcctgttccatgaaaatagaaaatgttcttattctctgaaaatgcatgctaaagtatttaggggtgaatgcaacaatgtctgcagctcattcttgaatcagttcaaagaaaaatgagttacatttatatatatatgtatgtatgtaaacagacatagataaaagtatagatgtgtgtgtgtctttagaaaggggaggattttttttttttttttgctgtgtgttactgaagtgcctatgtctgcgtgttcacactatcatattttgtatgccctggactttataatttctaccttcaaaattagatctactgttggtaattaattcaatatatactggttttttaactactattctcatttcctagcagtaatcttcctgaaaagtcacagaaatgattacattccttgttcttcataataatcactgtttaattaaaataagaatattttagaaaagatctgcggcatagtggttaagaccccagtatttgatgctaaacagatctgatttggataacagaaggtggcactttgctgtttaagctggggaccagacactgtgggtataaatagtaattccaaacacagctccacagagcagcacccttatgacaaggttttcatatgtctatagttaagccagaaaattaagaataatgccataaatatttataaagctgaacatatccaagttaaagacctttatcctgaaattgtatcttttagattattttctaaagactaataccatttaatgtttaaatgttctttggaaatgatggtgagaatacgtgataatgggtcattggttttaatattttatttagccaagtggaaaattggcaacctggtgtcggtcctcccatttgtattttactggtgcatgaaatccaaaagtctagtaaccattgggacagacaactctactgcataagtttgtatgtttgtatatctgtatcacaaagcccagacactcgaactatataaacttgtcgcactaaagacagcaaatatgtctggtaattgcatattcttcatgtgtgcactggaatttcttattatataagaaaataaatgtgtttctaaaccaccatgaattgggtactgctgatagtactattcttcctggcacatggaaatatcccactgaggttgtcaatcaatattgatttaatcagtgtggcagcaaaggcactagaggaggaaaatactctagacaatcaagtatagatgggaaaattgcatcaccaagaaattcttaaaatcacaagtggataatttgcaatatcaattgattttactcaactgcttgagtcctttatcattccgttagaacactcctcatatttgcagataactcagcccctcacctcagcaacaagcaagaggacatcattataaacttcctcaatttctttcctatccagtgaaaaatatctaagtcccttttcccttcccttttccttcccttcccttcctttttctttccttccattctcttcctttttccttcctttttctttccttccattctcttcctttttccttcctttttcttactttacctccccctcctacctttccctttctcccttcctccctctctcccttccttcctctctccctctccttccttccttccttcaatccatacttttatatcttttcagagatcaatttttcccattcatttctacattctcagataccttgctccatgacttgttctacttctcttctatctttattctttccctcttgactgatcctttttgtctgcctttgcattttcaaaatcagtttttctaatcttaaaaaataactttgctcaaccctgatgcatctttattcactgtgtcattatctcattatttttaaaggttagtttctaaagccagggctctatactcactaccttcactcttggttaaaattaaaagaaatataggtcccagtgatatttatgggaaaatttgactgtgaataatcttgttgatataaacactttgggttttcaaaatgttatgctagctgttaactttcccagtaacattatgagggaagggctggaaaatacaaaaggtagacataggaaccgagaacaccacccctatggagccaagctatacatactctgtctctggttatcataaatacatctcctatattcaatgcttgcttagaaaggcatgatgtccacggagcaattcaattgttcactgtgatgggtttttttgttttctcctcatggaatgcaacttttatttat

SEQ ID NO: 18455 - DNA, 8131 bp, Homo sapiens
  ENST00000640036
gaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtttgtaacagaatttgtaaacctaggcaatttttcagctcttcgcactttcagagtcttgagagctttgaaaactatttcggtaattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18456 - DNA, 8562 bp, Homo sapiens
  ENST00000637988
gtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcagaacagcataagaattatttctgagtggaggtgaggcttgtccaaatgtctttgctatcatggatttcctgactcctacctgtttgaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18457 - DNA, 10107 bp, Homo sapiens
  ENST00000635776
ggtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtaagaaatatttaaagttcttaaattcagttaaataaaagtgaaagctgaaacaatcaagattagattcaagatcatcccagcaatcagagataatcactgtaaatattttgatacattttatccaagtgtgtttgtttttttaacaaaatgtctcctactatatgtcagtattgtttcttattctatccatttagaacaatatacttagtgtaaatgtagtaaaacctcattcatttgaactagaactgtgctattaactaaaataaaaatgtttttgacatgttgagattgaagaaccaatatagtatctagatggttctgttaacaagactagaaatgtagtctggtactcacgaaaattgctttagagaatagacatggagtcaccagcatatagatattagtggaaagtggtttcaagataaggaaaagtattgcataaaaagagaataaagacaaggactaaacattagcaaatgcatatagtaggttctctgcaagtgtcatgtagagattttctagactaccttaaaaatgggtttatcataatgatgcacaagggaaataaggtggcatgggacatcatcagtactatacttcaaagcctggaacacataactagcctcatgagcaatagctcatttcattagacaaaactaaagctctagtaaagtaaaaagcatctgtctgtgggcctattcattcttccctaaacaggatgatatgattgggtcaatattttactatccaaaacgaggcacctgtgttggacagattttcatgccactcccctctctgaagaaactggccttatatccagctcattgtatatagcctttgattcccactaattataatccttggttataactagtgtggctaaggtataaaagttgtattctcacacgtctccttctctctctctctctctcacacacacacacacacacacacacacacactcttacacttcgtcttttcagaatgaggcatttaaacttgaaggcatttagtttcttgagctcttctttttaactttacaagtattgtttttatctaaaaagcaaatggagagagaagctgaaaataagaagactgagattacagtgttaggtacaggagaccaaaaagaattgaaatacaacattaagtacaggatactaaaaagagcatcaacctgggatcctttcagaaatgcaccagaacatacataaatgagtatataaaaatattagagtggaatttaagtaagtaccaagatcatggggagatgaaagtagcatcaaaagctaccaatactttcagatggaaaaggagtaaatagagaatttagaatatggcaatttcagaaaaagtcactgtatacatataaacttgtacctatactgttgggctgctactgttcggccaaatgtgcatttttaacttattttctttttaaattctgacttgggactttacataaactaaaagtagtttataaacatctcttaaagataaaaaaaagtactataatccttataattgaaattattgctgaatttcaaaattaagatttataatatattatgtacaattatatatatattatatatagttgtcatatttaatataactgggttcaggactctgaaccttaccttggagctttagaagaaacatatgtttattttaacgcatgatttcttcactggttggtattctcattgtttattcataggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18458 - DNA, 8508 bp, Homo sapiens
  ENST00000636194
ttgctgatttgtattaggtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggtaagcatattggaaggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18459 - DNA, 8533 bp, Homo sapiens
  ENST00000303395
caagctatttgctgatttgtattaggtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18460 - DNA, 8299 bp, Homo sapiens
  ENST00000635750
cattcagagagctccccagcactggtgcttcgttatgtaaggctgtctaggtcaagtgtaggagacacactgctggcctgtggaaactcatggaactgttcctccagattaacacttcaggggttatggaagctggaggaagctgagcttttactacatcttttgggggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18461 - DNA, 8097 bp, Homo sapiens
  ENST00000375405
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatt

SEQ ID NO: 18462 - DNA, 4268 bp, Homo sapiens
  ENST00000637038
aaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggataatcttgctccaacttggatggggtggagcgctggttcctcccctgagccctttattatgggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacaca

SEQ ID NO: 18463 - DNA, 5946 bp, Homo sapiens
  ENST00000409050
atggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttgggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataa

SEQ ID NO: 18464 - DNA, 560 bp, Homo sapiens
  ENST00000625916
taaagtcaattttgaattatttagggaattaaatattatcatacctaaagagtacaattttttttacattttaaatcccagatataattatactaatcagttgaattttgtatttctttttttagccatccattttctattttaacattgaaaaaaatgtacaaaaggacacagttttaaccagtttgatttttcttttctatactttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtgg

SEQ ID NO: 18465 - DNA, 544 bp, Homo sapiens
  ENST00000473295
atactgctttaaatatcatgacaccatgaactctaaagaattgaaaagtgcttgtgagttggttatcaaggggaggatatatcaaatggccattttgttcaatatgtgttctagaaatgaaaagccatactaaaatactgtcttggtccaaaatctgtgtaaaatttgttttgaaatgtctttcaaaaatattcccttttgaaaattatatcagtaagaatatttattaaacatcaggtctaaattatttttactccaaagtaaaacatgcatgtccttcttaataggccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaatt

SEQ ID NO: 18466 - DNA, 542 bp, Homo sapiens
  ENST00000491429
ttttaagatttttttgaaccttgcttttacatatcctagaataaatagcattgatagaaaaaaagaatggaaagaccagagattactaggggaattttttttctttattaacagataagaattctgacttttctttttttccatttgtgtattaggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttacttt

SEQ ID NO: 18467 - DNA, 168 bp, Homo sapiens
  ENST00000635893
tctttgcttcaagttgccacattcaaaggatggatggatataatgtatgcagcagttgattccagaaatcctctttcaggctccaagacctaaactgaaattcatgctcattccaactttgctcttcaaaactttgtggaactccagcctaagtatgaagaaagtctg

SEQ ID NO: 18468 - DNA, 4614 bp, Homo sapiens
  ENST00000637968
agtgtgaaccgtcttgcttttcagaacagcataagaattatttctgagtggaggtgaggcttgtccaaatgtctttgctatcatggatttcctgactcctacctgtttgaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtaagaaaaatgaaagaacctgaagtattgtatatagccaaaattaaactaaattaaatttagaaaaaggaaaatctatgcatgcaaaaggaatggcaaattcttgcaaaattgctactttattgttttatctgttgcatatttacttctaggtgatatgcaagagaaataggcctctcttgaaatgatataatatcatttatctgctgtgcttatttaaatgactttatttcctaatccatcttgggagtttccttacaaatctatatacaaaaaaaagctgatgcattattaaagtactatgtgtaatgatataatggtaatctaaagtaaattctatatcaggtacttattctttgt

SEQ ID NO: 18469 - DNA, 3606 bp, Homo sapiens
  ENST00000636759
agagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggttatttatccattcacctactgaaggacatcttggttgcttccaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaatggagttttgctctcatcacccaggctggagtgcagtggcgcgatcttggctcactgcaacctccgcctcctgggttcaagcgattctcctgttctcctgcctcagcctcccaagcaactgggattacagggacccaccaccaggcccagctaatttttttgtgtgtttttagtagagatggggtttcaccatgttggccaggctggtctcaaacttctgacctcagacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtg

SEQ ID NO: 18470 - DNA, 921 bp, Homo sapiens
  ENST00000642141
gtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacgcagtctcgctctgtggcccagactggagtgcagtggtgccatctcggctcactgcaagccccacctctcgggttcacgccattctcctgcctcagtctccccagtagctgggactacaggcgcctgccaccacgcccggctaattttctgtaattttagtagagacggggtttcaccatgttagccaggatggactcgatctcctgacctcgtgatccaccggcctcggcctcccaaagtgctaggattacaggcgtgagc

SEQ ID NO: 18471 - DNA, 711 bp, Homo sapiens
  ENST00000507401
accatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaagtgagtgttttttatcaggcatattttgctgctaattgcctactgcattccttgga

SEQ ID NO: 18472 - DNA, 100 bp, Homo sapiens
  ENST00000637285
ttgcttttcagaacagcataagaattatttctgagtggaggaatttcatatgcagaataaatggtaattaaaatgtgcaggatgacaagatggagcaaac

SEQ ID NO: 18473 - DNA, 8191 bp, Homo sapiens
  ENST00000423058
aaaatatctgtattccttttattttaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 18474 - DNA, 8169 bp, Homo sapiens
  ENST00000640791
agagtaaaaggtctctgcacataaggacaggaaggggatgctgttcagtgctcaattcttttgaggctaaaggagatccagaattccacagaccattatttcccagacagtgattggaggaatactactgttctgctggactaatgaagtgccactccacatccaccagaatggctacaacttaaaaaggcttatcatactgtttgtgagaatctagagctacagaagctgtcagagacttcaggtatcttcacatgaaattgagcttcaaagaagatgaagatgagtaagggccgggaaagccagggaaggtttctgtttcctgtgtatcaagtttcccaaacaagaatcttggagtcctcttcagcttctgcaactccttctcgatcaacatgcagtcaaacttcaaattgtattgacggaaactcagaactgcttagatcattttcttactctcattatttctgcgtggatttagacattcattgtcttttgcctgggctcttgcaataggcttttatcttatatcctaccgtaaaaggtttcagatgctacacatcctccatactaccaaagtaataggtaaaaaataaatctgattgtgtctgtacaaaaaaacctgttagaactaataaataaattcagtaaaattgcaggatacaaagtcaacatacaaaaatcagtagtgtttctaaacactaagaatcaactatttgcaagagaagtcaagacaacaatatcattttaaagcatcaaaaatattgaggaataaacttaatgaggtgaaatatctgtacaccaaaaactataaaacatggattaaagaaattaaataagacacacataaaaagaaagatatcccgtgttaacgagtggaaagaattaatgttcttaaaatacccagagtacttaaagtgatctgtggattcaatgaaatccgtataaaaattccaatgacataatagatattttttaaatcttaaaattcatatggaatcacaagttaccccaaacagtcaaagcaatcttaagtaaaaataatgaaacttggttgcatcacactgcctgatctcaaaatacattacaaagttgtagtgatcaaaacagcttggtactggcataaaaatcagcacacaaatggaacagaaccaaaagcccagaaataaatccatgcacttatggtcaataaatctttgacaaaagtaccaagaacacaaaatgggaaacgaacagtctcttcagtaaatgatgttggaaaaacttggtatccacatgcagaagaatgaaattggacccttatctcacactatatacaaaaatcaactcaaaatggattaacaacttacagaacacctaaaactgtaaaagtactagaagaaaatataggggaaaactctatgacattgatctgggcaatgattttttgaatctgaccccaaaatcacagaccaaaacaaaagaaataatcaacagaatgaaaagacaacctacagaatggaagaaaatatttgcaaaccatatgttcaataaggggttaatgtctaaaatatgtaagaaactccaacaactcaatagcaaataataataataataataacctgattacaaaatgggcaaaggacctaaatggacatttctcaaaagaaggcatacaaatggccaacaagtgtatgataaaattcccaatatcactaatcatcaggaaaacacaaattaaaactacagtgaaatagcacctcacattcattaaaaatggctactatcaaaagaacaaaagataagcgttggtaaggatgtggagaaaacaaaagtgttgtacactgttggtgggattgtaaattagccatcatagaaaacaatatgtaaattcctcaaaaaagtaaatacagaactattgtatgatccagtaattctacttctgggtatatacctagacattcaaagaagaattggtaccaaccctactgcaactatttcacaagatagagaaagaaggaatccaccctaaatcattctattaagtcagtatcacccaaataccaaaatcaggaaaggacacaagaaaaaagaaaactgcagactaatgttcctgatgaacatagatgcaaaaattctcaacaaaattctagctaagcaaatccaagggcatataaaaaagataatacatcatgatcaagtgggtttcatacccgggatgcagggatggtttaacatatgtaactcaataaatgggatacatcacataaacaattaaaaataaaaatcatatgatcgtcttaatagacacagaaaaaatgtttgataaaatacagtatccctttatggtaaaaaatcctcaacaaaattggcataggagaaacatacctcaaagtaataaaagccatctgtgacaaacccagaaccaatatcatactgaatggggaaaagttgaaagcattccccctgagaactggaacaagacaaggtgacaaaattagtgtgataaagagatatttacactgtcgtgtttattgcagcattatttccaatagacaggatacggaatcaacctaagtcttatctgtagatgaggaacggataaagaattgcacacacacacacacgcacacacacacacacaatgaaatactcttcagccttaacaaagaaggaaattctgtcacttgtgacaacatgaatgaacctggaggacattaggttgagtaaaataagccaagcacagaatgacaaatattgcatgatgtaacttaggtatggaatctaaaaatgtcaaactcacagaaacagaaagtagaatggtggttaccaggggctactgggtagggctgtaggggtggaggaatggaaaatgttggtcaaagggtacaaaagttcagttaaacaggaggaataagttctggatatctattgtactatgtaatgactgtagttaataatactgtgttgcatattcaaaaattgctatgtgtcgattttaaatgttctcaccaccaaaatataaatatctgaggtgaaggagatattaattagtttgatttaatcatttcacaatgcaaatattaagttgcacactgtaaatatatacaatttttaattgtcaattaaatataattgaaaaatagaacataataaaatattggattattaactctatcaggaaatgaagctttgagtaacattttactgtttatatttatggttttagccaccaagcaaacatggtggtcaagaacttggactcacattcaggttgccatagtccaaattcaggcttccctactcactaatgtgttcttaagcaagaaataaacttattttggcttcctttggtaaaatgggattaataattgttcctatcctacattttattgtgaagattgaattaatgaaatatacacgtaaaacacttaagacaattcctggccttagtaagatttcaacaaaaatggtcattattatgatgctttattctgttacatttatggattattagacagataaaattggacctcatatgtgaccattctattttcctttattcaaatggaaaaagaatgtcaattcaacatagggaaatactatatatgtataaattattacttaaatttatgtttttacttaaatatatgtttattaaaatcaagtgtttaaatttatatattaacttttacatttataacatcttatttcttctgaaaacaaccaacacaacccatttcttatcagtgataattcaaatggcctctttattctttcctgaatttttcaatcccaattcttctcttctgttctttttcagcagcatcttgcacagggctttatggaaaagactgaggtgctgtggtgaatttaatctcctctgttgtttactttaatctcttcatccagttactctgacttttctccatgcttaatgttatccctcttgatttcacagcttaacaatttcttctttgttcttgaccccatcctagccttcttatttcaaaagtcccctcaagcaagtttcttttcacattcttaatttcttattcttaataactccttttttatgccttcaagcaagtatggctctctctcatactgaaaatgtgctcttccgttctattttgctactgtttttattcacttaacagtaaatttcaaacaagttttgtgcacctaattctttcatttctttacaacccacccattgcttatccactcttacagctgtactagaattgtaatttaaatatgtatcatatcagtttttttgtaacattgataatttataatatttaacatattttgtaatagagttttcttcttaatattttactttccttttaaaaagcctcagcaagttgccattgactttcggcattgtatttgatacctctggactctggctactatcgccctttctgtataaaatctgtaacttgaccaaggcaagaacctccaccccaggccaactaattttctcatctgctattgtcccaacctgctttggtttctcctataggtcagagtcaggtcctgcttgggtttgggcctttgctcataattttcccttgcaattgaaatattctctcactccaggccagcctttaaagcctaacgtaagtaccaccacatccacgaagcctctgcacatcaacttcagatctcaatgctgttaaccttttataaacaaaaagcaatatagaataaatcctttttgggagcaggagtcaaaatgctagttgcagtcttgcatctgtcacttatttgcttggccagtgacgtagccttattaaaaactcaatttctttatccaaaagatgaggatgtttatacctccctgatctaccttctaagattgttgtacatgataagtaaaatactgtgcataaaaacatttgtaaaaattttaaaaatctgttcaagcttgtcattgttaccacagataaatcgggtactaccttgctgtcttggattgcttttgtatgttgttctcttatgttgttactggactcggtgttattacttaaatttctctgtatttattttgacaacttaattaggttttgaattctttggaagcggagagtatgaatggtattatgagcaaagacccagaaggagccacctcctaattattttggagagaattatctaagaggcctaattggacttgtgcttcccattaaagtatgattcatatcagagaagcttacagtcttattgctggccacatggagatagtacataggagatactcgatgggaattctgtcaactgaaagagagtcagcaagacagtgtaaacatggttagcgtgtctcagcttacccagcctggcttggtgtaaccaatatagactatggaaaataggaagtagacaaaaggtagtggagattgggctcatgccattttctttaattgaaatacaatttccataaaataaaatacagatatttttaagtgcatattactttgagttttgacaaatgtattcccctgtctggcaactgctccaattaagatgtagaatatttctatcaccccagtacccttttcctgtcaatccctccttctcccagagacaatcactgttccaatttctatcactatagcttagttttaccagttcaaaaacttcacataagtagaatcataaagcatgttactttttttcctggcttttgtcacttaacagtttttttttttagatttaaccattttgttgcatatgtaagtatatcataactttttgttgttgagtagcactctcctatataagtatgttataataatgtttcatttacctattgatgagcatttgagttgttcctaagttttaactagtataaaaaagtttactatgaacattcttgcataggtctttttgtgggtgtatattttcactactcttaagattgtcagactggataaagagcaaagttcagtggtatgctgttttcaacacatattttaaatataacacagacaggttgaaagtaaaaaaatcagtaaaagatacagcatgaaaacactaagcaaaagaaagctgatatggctatatgaatatcaaaaaagtagattttaagacaaaggatactaacacagataaaaatggtcattttattggggaaaaaaaggccaatttgtaacaaggcatgacaatcttaaaagggtataacaaagtagaatttcaaaatccaagaagaaaaaaatggcagaataaagtaaaaagcagagaaatccacaataattgttagagattttatcaattttatcccagtagttgctagaacaagaagacaaaaaatcaatgatatagacaacttgaataacattatcagggatcaaacctgcagacctaactgacatttatagaatattatacccaacaacttcagaatatacattcttttcaaatacacatggaacattccacaggtggtgttatgctaggccataaaattagtgacacttcatttcaaagagtatttgactacaatggaattaaattagaaatcaattacaattagatatatagaaaaggcccctttttacaaaattaagcaacagacttctaaataatcaatccatggatcaaagagggaaatcacacacacacacacacacacacacacacacacacacacacaaatacagtgcgctatacggagtgataattagaatacaacatgttaggaatctctgtgttcatgcctttaaccatttcatattatttcataataatcaagaacttattaatcaaattagcatttaattatcttcagatgaaatgagaaagagggtgggcaaaatgtagactgaaggctgagaattataggaattatggtcacaatcagccagtgttttaactctactgcaattgtaacaaagtcattggatcttggttcaaccaatgggaatagatcctttcaaaatgccaataaataaaatgctaaataaacattttggcaattttctcttgataaatctcttatagcaatgtgcataatgcttccattttcatccaatgaagtactagtgaaaatagtctagatagtgttaatattgatagaaattataactaaggaataagttagatggtgattaaagagttgaataagcactcaaagaaagttgtgaaatctctgttctgagatatgtgacaaaaccatctgtctctgattttagtttaatccttaatgaatataagaagcctgactaaatgatctcttgggaggcccccttccaaacacaaaacccattattttaatttgcattggttatagtgccaacacaaagaaaaaacacactcaagatcttttttataaagtagggatttaattctaaatcttagtcatatcttacaatttataaattctttaatgttgaaaaatattttctttgtagaactaaaaccattctctctctctccctccctccctctctctctttctctctgtctgtttgagaacccaaaataaaatgtagtttataatttgtgattatgatttgaacttttcaaaaaatgtatgagtcatttcttgccctttgataatttccaaatgatgatgctttgcttttgcttttagagatcagtctttgcttttaattatttccatatattttggttgggagtgagaaaaataaacggaaaatgtcactcatgagtgtcagcctggtaatgaatatatagaatgcaaatggtcactttactgggggagacggtaagtttttctgagccttttgcccttttatcttctccagcctgctgttttttctgttttcatttgtagattaaactggtgcagcaatatggtggggtagaaatcacatgaatctgacatatgtgggctcctgtatctgtgcacatggatagagatgctggtcaaaatccaaccatcttatgagttccagacatacttttaaaattcacatgcatgaagctatacaaaatattttaaaatacagaatccaaaataaaatttctttttgtataaaatactccttctcaattcattcctgtaggcaaaacttgatatttaataatattaagaaaaagaagaaaatgaattcgaaatattttattgctttacaacacaaaaaaaatggtttacttactcccaataatctgaatttattccaatagtatatttatggatttaaccaggagagggattatcct

SEQ ID NO: 18475 - DNA, 9007 bp, Homo sapiens
  ENST00000636384
gcctttatttatttatttttctaatttagcatgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagattttttttttttatatttagcctccagaaagctgctgcaaatgtaaggtaaatcttttgaagattgtctggccttccgctccttgccatagcaaaaccactgagaggaagctgccagtggttctgctaccgatgtcagcagcatgtctgctccctaaagcaggaagtagagaaggagacaggaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18476 - DNA, 1807 bp, Homo sapiens
  ENST00000424833
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaa

SEQ ID NO: 18477 - DNA, 8881 bp, Homo sapiens
  ENST00000636071
gaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcaggggtttttctccctttgcttgacacttctctgtcctgacaccttgagaagaaggatgtgtttgcttacccttccgccatgattgtaaatttcctgaggccttcccagccatgcagcactcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18478 - DNA, 4408 bp, Homo sapiens
  ENST00000637367
gactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactgacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaaatattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacaggaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctg

SEQ ID NO: 18479 - DNA, 3119 bp, Homo sapiens
  ENST00000635945
agaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagttacagaatcctcttggggctttcttagagccaatctcctctaaggtgaatgcattttcttgcattcacctgtcatgaaatggcagtggaaagacttgaagaaggcacaggcgttgcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaata

SEQ ID NO: 18480 - DNA, 8856 bp, Homo sapiens
  ENST00000636985
agaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactgacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18481 - DNA, 8430 bp, Homo sapiens
  ENST00000631182
cctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggttt

SEQ ID NO: 18482 - DNA, 8519 bp, Homo sapiens
  ENST00000636135
tactccagtaaaaattctgaagaattgcattggagactgttatattcaacacatacgtggattctgtgttatgatttacatttttctttatttcagaatcatttgtataacaagttggtatattgctgagcacatctgtaaagtaagacctgaatatggatttgataattgaagttgacactcatcatagagatttatgaaatattgtgcgcttgattgcagtaggacaacttactatggggaaggaatcttcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggaatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggttacgctgatgcaagaggtgggttcccttggtcttcagcagctccacccctgtcactttgcagggtacagcttccctcctgactacttccatgggctggcattgaatgtctgtggcttttccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataa

SEQ ID NO: 18483 - DNA, 2832 bp, Homo sapiens
  ENST00000638151
attgtagagatataatgaagcagattaacatggcagtggctctgccaaagctcagggctgagccttctgattgcagcctcagaggcaagccaatattctgagtccaaaggccttttgaacgatttctgctggctatgatgggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagac

SEQ ID NO: 18484 - DNA, 8610 bp, Homo sapiens
  ENST00000637266
atagcagtaacacaattcacctctagtgtgaacatatcaggatggcatagaccagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18485 - DNA, 8660 bp, Homo sapiens
  ENST00000283256
aaaaaaaagatttttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18486 - DNA, 9456 bp, Homo sapiens
  ENST00000636662
aagatttttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactggtgaggcatcctccagcgcgggaattaaggaaggacaaaagcctattcaccttcttgaatacaaattatatgcttaaaccagtgtaaattgaccctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatgacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 18487 - DNA, 11676 bp, Homo sapiens
  ENST00000480032
ttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaaatacatatacattcatagataaaaatcaaatgccatcatactatacttattcacttaatttcaaattaatatttaaaatctcaagttatgcaaaataaaatatgaatttagaaattttgctttttgcacactcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatagaagcaaattggctattgaccaagtagccaaagattttattaaaccacattggtgttgaaataaaataagatagagtactaaaatatgagggtttttatataattgaatatgaggcaaatctaccattaaatgtactactactattaaatgtataaaggttacatgcagaattacattaacagtctctggcaataaaggaagacaataaataatatttagaactacataagtgtggacattacaaacaatagaaaatgcaccaaaactataaccattcttttatttgtataatgggattatgcatgatactatttcttttctctattttctgtatgtacttatcataggttggtaaatccataataaaaatatctgatacttgatatatctatgttaggataaaagtatcaagtcagcactgcttgaatataaggaaactcttcagagaaatctagttgtcctgcagctaatgatcatattacccaaagtactctgatatttacctttttagatttaagaaaactattatgatagtatatgaaactgatcaacactttgccttaaatcaaatatgcttattgctcatctatttcattatgaaagatacaaatataaataagtcatttttctagtcctgcagtagcttacagttgaaaagtgaggacagctgcgtacacagtaagtcgacacctgtattacaagtgccacctctttacttgaggaaggaggaaaggcttcaatagggaagtggagtgtgagctggagcttgagagatgtgaatgctagcaggcacagctgagggaggaacacggattcgttaaaacgttggtgcatgacatgcagggcgggttccagaaacaagtagatagggtgaggtaagcctttgtaatgggatgataaggtaagaaagataagttagaaaagatctgaagaacctgagatgccatccaaggaaatttggacttattatttaatacagaggaagctattgaagaattacatatagggaagtgacaagacctgcttgttcttttagtgagggaagttaggtggaggtgagaatgacggaatagaaaggagatttatttagagatcaaaacaccaattaggagattgctgcaatgtcccagaaagagaaggcctatatgtatcttcttttccacatttagctacacaagtcacataaaactgaatattttacaacttcttttcagccagtaaatactaccccattcaaaatattttcctctgtctaacttttatctttcatcctttaacttatgcttatctctttttggttctgtcttcagagaaggtaaagtactacaggtccttatatcttaaatacagaaaagcttcacaactcatgataattcagtaactatttttcaattatctgttaaaaagggacttacaaagcctaagagtttggattttaagggaactatatgaactatgtaagacataattttacaactcattgttttctgtattcaagaggcttcactttcaaattgcatgtgcaaaattattttgaataagttgttttttgtaacaactttcaatgtgcttcacttattttccttaaaaaatatatttttcaaatatattaacaccatactcttaaaagctgtattgcatatttatttttatttatctgcttttgaaattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagactagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagataagtatattaaaacttcatccttgctctgaaatatgaactaaatatttcatactctttcctttagcctccaaaatgcaatcaccaaaaaaagaatataaaattcagaaattattttgagacatttgataatcgataagcttttaagcaattaataattcagatagcatgtttttgatatttttagtctagaaatatgactaatatggcataatttatatattgaataaaggcatctctataaatacagatattagtaacaatagaatgaaatgtgggagccaattttcacatgattactaaggtggattttatagccagcaaagaacacaattttaacaagtgttgctttcatttctttactttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtattt

SEQ ID NO: 18488 - DNA, 8573 bp, Homo sapiens
  ENST00000636769
tgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaaggtaaatcttttgaagattgtctggccttccgctccttgccatagcaaaaccactgagaggaagctgccagtggttctgctaccgatgtcagcagcatgtctgctccctaaagcaggaagtagagaaggagacaggaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacac

SEQ ID NO: 18489 - DNA, 661 bp, Homo sapiens
  ENST00000486878
tggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgata

SEQ ID NO: 18490 - DNA, 8792 bp, Homo sapiens
  ENST00000375437
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 18491 - DNA, 8553 bp, Homo sapiens
  ENST00000375427
cactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 18492 - DNA, 5826 bp, Homo sapiens
  ENST00000278947
ttttctctcccccccatctctctctctctcctttacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcagccacactactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaagaggggcaatacaacagggtcaagggtgcagaggccaggcagagtgggtgcagagtgggggatgggcaaccagcctggtaacacctgggtgaggtgagcgagtcaagcccatctggaaatgctaaactcatcagctcagtacctaactgccaatcaacacactgccaatgcgggtgggctaagccgccaggatgcctgcagcagatggacgctgcccatccttgagccagccagctgggggcagagaggtgggtggcgggcacctcatgccagctgagaccaagagtggttgtatacatttctgcagcttgcagatttcatttttttggtcaccctttaagtgtccttctctcccaggatgagtgaggagctgtgctgatgttgggaacttatctttttccaggatccataacatttaggggaattatttgcgggctttcctagtgtattctaagaagttctaactctccatcaagaagcccaagattcctggagtctttttttcctctgccctgatcaactggggcccaggaaaagcaatgtctcttcacgggcctcagggccccagcagatggggctgggtcaggaaccatctctgtcccaggtgctcagccctcatatgcattttcttctggagcctcttagaatctcctccagaggactcatagagctgcctcccccaggatggtgaagttgggagcaaaatggggcttctgtaagtagaggtggaaaaccagagagatgtttccacagcagccatttccctaccctgtttcctaacttatgctgacaagttcttcctcttcctaccgtggggttcgagccccacttctggttgcatgttcccaccaccacgctctgctggttttagtcggctgactttctcaactgccccagcctctcctgctctctcagaacctccctctgcccccaccccccatctgtctcttcctcctaattaagggccactgcaaagagagacgggctggctaacccatgggatttagcttataagaacaaagcacaattattcaggactgaactgctttgaggtgccttggaactggctttggaaatagctatctgccccctagctatggactcttcacagttatttccagtttataaaaaggaaaagctgatcggatccatgtttctctctgcgagtctccttggggaggttgggctggtaaatatttgcaaggtcaggttaagcagacagacaattgaaaatactgggcaggtccaaaaggatagttccaggccataggaatggcttggtgcagttaacgggtgatgaagcaagaaatcttccttcctacttatgtcttaaagatggacagcctgtgtctcttgctgtgcctcttgctggcgtcttcctttattgaagcttgctgatgcactgtacatagtctctctctctaggtatagatatattatatatacaaatatcaaacatctcaccacacccaccccaaaagttacactgtgtgtgtgtggggaggtgtaataacttctcagtgttttgagttgattcaccaaaggcaaattttggaatgttcttgcgctttgtgcacttggaggggaaaacccaactacatatgcactttcttggttgtgtgtgctatagagaggttggaaggggtggttggaaggggagagaaactgagatggccctctgtgactcgactgctgggatgtatctgcttttgggagcagactgagtttcttttgcaatttgtcttattgtttgggtctactggcaacaataaactatctcccctgaaaatccctcgagtgtggctttattcaggggttcagggcagggtaggctgatgcttcaccaggatcttaactggaaccctaggtgctcctttcctggtaatcccattggcgctgccagatctccagcatctgagggcctcaatgcccctgcctcacaaggggaaggttgtctaccccacacttgtgcccccacagatgtttcatccctttgccttccccaaccccctggggactccgctcaccctggaacagagtggctgaacacctacttcttggagggctctcgattattttggggatgaagacaaccccggaagctcccaaggctgactgtcatgcggatgttgcctgtcctttgcatgggcagacaggccatccttcctgctctgttccccaaaggtgttggattagacatttcttttgcctcctctggactcagaaagaatagatgacagctggtcagagtctgccctcatgcagttcatggagaagggtggctgtgggaaggttcaggtggctcatgtcccatctacatactgctggatcctatatatatgtgccaaagcagccctaagaagtttaggaccaagggcaacctcctggctaggggctccactgtcccagacaggcctttttttctcccttgctcttcattcttccgtctctttgcatttctccctctctcccttgcaccgctctctctctctctctctctctctctctgtctgtctgtctctctctctcttgcctaggaggcttaccaggcttaccttcctcttcctactctggggttcgagccccacttctggctgcatgctccggccaccacgctctggtggtttcagtctgctgactttct

SEQ ID NO: 18493 - DNA, 4480 bp, Homo sapiens
  ENST00000415030
agtcctttccaggggagaaatggagaatgatggagggtggcccaggcggtgctgattggagtagacagccatcctcccgaggttggcactgagggtgatagagacctacctgcctggccaagctactccgccctgcctaagcatccccttccagagctccaggctggtggggttttattaagggaggcggtgctccttacacaggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataa

SEQ ID NO: 18494 - DNA, 4484 bp, Homo sapiens
  ENST00000324727
ctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttgggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataa

SEQ ID NO: 18495 - DNA, 3969 bp, Homo sapiens
  ENST00000423160
ctttctgtctgggcttctgtcacccagcttgtactcagccttttcagaaggaagagaacgggcatttgtggagcgttttctgggtgccagatcccgatggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaat

SEQ ID NO: 18496 - DNA, 1206 bp, Homo sapiens
  ENST00000531550
gatgaagaaactgaggctaggagggttcaatgacctgcccaacattgccagctagttagtgacagttaaatcccatgcttaaaattcagactatctgactccaaaatcttctcaccatctaagaggtatcatagggaggttcttaattttttctgtgtgagcaaaggggtctagaaagaggcaatgaaattttcgcctggcaatttggggatcaagtcaccactcaaacttgagtgttataggctccaattctgatttattccagaactcgtgtgagtgcatctgtgggagggcatgtgcagggtgggggagagggccccttatgtgtgccctagcctgatagatgccatgctctgcctctccagcttcctgctgcaggcctggggagggctgggggtctgggagtggatgtgccccggatgccagggggtggaggctacatggcccttgcactgccacagttctcggctccaggttgactcttgctccctttgtgccttccctttcctccctactcgggccacacagtggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctg

SEQ ID NO: 18497 - DNA, 566 bp, Homo sapiens
  ENST00000529878
agcagccggctcccagcagcgggcgagcgcgcctccccctccgctccctccctccccctcctctcgctctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttggtggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccc

SEQ ID NO: 18498 - DNA, 850 bp, Homo sapiens
  ENST00000532138
cctcctcgaccgccccgcccgtcagtcctgaaaacctggcgagaggcgcgtactgtcctaggggaattcccctgcaaacagaagggagcccgccctgcgcgtcctggagtgggtgcggcaggagcgcttccaggcactgcgtccccaggtgaggggcggagccggggcgcggttcgcggcagtggccaggcctttgtttccttgggttggggtgacccctggtggtcatccagagcgcaacaagggctactccctggtccagaattcagtcctttccaggggagaaatggagaatgatggagggtggcccaggcggtgctgattggagtagacagccatcctcccgaggttggcactgagggtgatagagacctacctgcctggccaagctactccgccctgcctaagcatccccttccagagctccaggctggtggggttttattaagggaggcggtgctccttacacaggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctgtggaagaagtggacaacacagtgacactcatcatcctggctgtcgtgggcggggtcatcgggctcctcatcctcatcctgctgatcaagaaactcatcatcttcatcctgaagaagactcgggagaagaag

SEQ ID NO: 18499 - DNA, 9768 bp, Homo sapiens
  ENST00000409672
gggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 18500 - DNA, 5967 bp, Homo sapiens
  ENST00000409435
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 18501 - DNA, 1585 bp, Homo sapiens
  ENST00000454569
attctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcc

SEQ ID NO: 18502 - DNA, 1618 bp, Homo sapiens
  ENST00000452182
attctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcc

SEQ ID NO: 18503 - DNA, 905 bp, Homo sapiens
  ENST00000472119
gtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatga

SEQ ID NO: 18504 - DNA, 9786 bp, Homo sapiens
  ENST00000303354
cggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatac

SEQ ID NO: 18505 - DNA, 3507 bp, Homo sapiens
  ENST00000300061
ccacaagagcccgcggtggcgctgccaggggatgctagcccgagagcgagcagaggagcagcgcacccgcacgagccttggaccctttggaaccgaaagcacgcccgtcctcagagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctgacagagtccttcaagctgagtgagccctacagtcagtgcacggaggacgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgcagctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagagcccttggagtgttggtggagatcagagtgccgtggtggaggtctgggactatgtcagagtgtcctcactttggggcatgggtgggtccaggagatggatttagttattcaattttgtggatgaataaattgaggcacagaaagattaagttaccggcccaaggtgacacagtgaggaggtggcagagctaggatttgaacccagacaatctgacttcatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccaca

SEQ ID NO: 18506 - DNA, 3779 bp, Homo sapiens
  ENST00000569446
gtggggacccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggcgctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccttcaagcaatagggtcccgaggggagacccaccccgagccccctcccctcccctccagggtgcccccggctttctcccagcaatagggtcgacgagacctagaaccgaacctcatctccgagttgggtctctgaagacgggggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccaccccccacccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgcccctgagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcagactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgggggctgcggccgccggcccgcccgcccccacccccgcctgtgccccgccgccttgtacatattcccacccggaataggccgggatttttactcgggccgtgcccctcttccgcccccatttggggccaggccggccggacagacggacggacggacagacctccttcctaagcacaatagcaccagctccccggagcaccgcacctccacaaggagaataaatgccactcttgatagaa

SEQ ID NO: 18507 - DNA, 9808 bp, Homo sapiens
  ENST00000360835
ggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaacgggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagcatttgcatttgcccttctgtttctgtgaggccggcagcccttggggctggggagagcacagcttgccttggacttgcttctgaacacgaattcttcgagaactaggctcagatgctctgctggagtgttggcctcaccccagtccccttgccagcaacatcactgcccttggacgagactcagtggaagacacttcccctcggacccgttcccaggaggtgcaggggcccagcaataaacggcgaaaggggccttggctcttgccctgtggcagtgaccttggggtccgtactatgcccaggtgtcagcaggaaacaaggccttgctcacaggagcacaggctgtaccaccacaaggagcctcagagcggccagtgaggaaaggggagagagcagagcttgctgtcagaggccaggctcccagtgcagcctcctcttgctacgccatgccacccccattcacagggaaacctctttccttcctataaaggaaagaggttgaattgactcacatttccacatggcttgggaggcctcaggaaacttacaatcatggcggagggtgaaggggaagcaagcgccttcttcacaaggcagcaggagagagaagcaagcagggaaatgtcgggagaaagagagtctgggctgtgaccgagtgcatgtgtcccacccagccggaaggccagcgcctgggatggagccagcagaaccccatgccgaggtccaggaggccttgcctgctcttcatctgcctgcgagctgtaggacctgcatgggaaatggtctgtgtgtttcaggttaacaaatactgaaaatcccaaggaacctgggagaatctgaaaatgaactccagtcttcagctcgaagttgcctctagggttcctcctggtcacccccgggcccagcctggctggcgagaaacaaacacggtttgagaggctgtggcacactgaggaccacacagatggaggcagccaagtgaggtccctggaggttcagggcttggtgacgaggtaggccgtgatcacatattctacagtccaaaagagggcccggagctcagcaattactcacgccgtcacatgtgcccacagtagcgggctccgcggcgtggctcctgctgccatcagctgccttctctgctgaagtccaactcaagtcggagagagagtggagcctctgcacttggggagtaggtcagtgtcaactaacaagccctgccaggggccactgccgctcctctggtcacagtccacgcaggccagccctggtttctggaaagaggcctccctccctccctttgtggagccgtcagtcatccccaagatgagaggcgagcatcctgccgagtgagcctgcagcaacagctcctgaggaaggtgccgggaggggtgtcgcctcttcacgagtgttctccagagaatcagaacccagaggatacagacgtagatgtgtgaggggctgcattatgggaactggctcacagattctggaggccaacaagtcccacgatcggctgtctgcgattgggagaccaggagaagccacaccgtaactcagtctgagtccaaagcccgagaagccaggggccaccctgtgagtcccagcatccaaagccccgagaacgaggaagatggatgtcccagctcccaaagggaggattctcccttcctcctccttcttttctattggggccctcaacagattggatggagtggatgtcttcactcagtctgccaattcccatcctaacctcttctggaaacaccctagcatgttttcccagctagctgggtatccgttcacccaaccaagacgaccatgcaatcaaccatcacacttaaatgtttttgttttgttttttttgttttgttttttgttttctttttttgttttcttttttttttttttttttttttttgagatggagtctcgctctgtcacccaggctggagtgcagtggcgcgatcttggttcactgcaagctccgcctcccgggttcacgccattctcctgcctcagcctcccgagtagctgggactacaggcacccaccaccttgcccggctaatttttttgtatttttagtagagacagggtttcaccatattagccaggatggtctcgatctcctgacctcgtgatccgcccacctcggcctcccaaagtgctgggattacaggcgtgagccaccacgcccagccagggttttcttttttaatcctttccagaaacagaaagagctcttaacctctctgagctctttctgcaattcctttgggcgatttctgaaagttgccacccacgtactcacagatccactgcccgcctctcctcccctcatgttccaggactcaccaccgtggtcagaccatgcccagtgtgcccagggcaaagttggatgggcaggtgcagacgaggcccagccttcatcctgctttccctcgcaagcccttctatagctcccagcccacgggagaggccatgaggagcgcgaggtcgccagcagccccactgggcctcccacaccatctgagtgacttgaattccagggttgggctctgtcttgagtctccacatcagtctcacaccagggaacttgggggtcccccgttaaactacagctgaccctgggcctcagggcgggatggtcccaaggtgagctccgtggacagcaaagcgcatttcttccagttggcatgttgtcgaagccaatggcagcttgactgatgtgaggtggctattccacctggttcaagatggaggtgtagagaaaagggaagtggggaacaaggactgggccaggtaggacggatccacgtaacgaggcccaagaaaaaatggaagctgggggcagagagtccaggaggcccccatgctgtctgaggggaggccggcatagcccctcctcgactgtcgcctgagcagctgatgaggtccccagcgccgcacgctgtgctccagggagaggagccaagaagcaagcgggctgctgggagtccctgcactgccatctggccgggacggaggcgcctgcccggtctccaggctcctctgagcttgggtcagctcctaatggagcatggcaccccagggaaccagaggaactctgtgaagaaaggcatggaaaaccggggtgtctcccgcacagcttcccaggagtcaggtgggacccaggcgtggggggacctttctgccccacattcctggcattccccccaagtttatttctactttccagaaacaagccacgggaagggaaggaacctgcagcagggtttcgaagacagccaggccctccgtgattgagggctcatatagccgctgagggcagcctgcagccaggtggcctcacctgctgcccagaattaggctgtgccttttcccagtccttccccatgccagagcctctccccatctttccccgcgccagagcctcacagccacagccacaccaacctccctcctctcaagcagcagaatcagcctacgctccccagcctcagtgcccctgccccacacaggtcacgctggcaaggcgatgaccagtttccgaaacgctggatccccaagggtacagtgtggcccagtcctcccccacctccatggtggcccaggctgcagggctcacggtgggcccacggtggaggcctcaggcagctttctctccagctacccattggcttaggacacacagataaagtagagctgaaacacgggccaaaacatccccagacaaggatggcacaagaggccaaatttgaaggccttgggagagaagccatttcccctacctctaacgagcgtagttttctgtctgaatggccccccttttcatgcacgctcgttcttaagagacgcaccatccgcaggcagcgtctcagtgaagcctgtcccctgggcttgtccacggcaggaggcccctggcctgtttaagccataccgatgcttaatttacatttttggagttgaatattattccggtgcctccaccacccccagcagaaaaaataagatactgaaataagttgagtcatttcgcaaacatttactgagcacctcctgtgtgccaggctcctagaaagacagggagttggtgccctgcacagatgacaaactgccccagacagcagacagacaaacaaactgccccggacagcagacagacaaacagacacattgccctggacagcagagagacaaacagacacactgccccggacagcagacagacagacacgttgccccggacagcagacagaaaaactgccccggacagcagacagacagacaaactgccccagacagcagacagacaaactgccccggaaagcagacagcaaactgccccagacagcagacagacagacacacttccccagacagcagatagacagacaccctgccccagacagcagacaagctgccctggacagcctgctcaccttgcctgccacagtgcatgccccacagggagaagccttccttctcacccagggagtccagccattttcacctcccctggtccatgctcaggaagtctggtcaccctggcaaactgcacctgacattgaggtcccttttcaccaaagatgcacaaggtgtccatgccgagccgacatcattcaggccaagggcagaggatgtaatgaggggtggagtgaggatgtggagagagagcagagagcgcctcctattctaccgcggctgcctctgcccccacagcacccacagatccctggcccttccaggagtaagtcctgggcaggcagagctggggttggcctgatcccacctgccttgctcttggaaaggacatcaggtgtgggcaaagcatccttgaagcccagacaacacaggcatggcctgcgtgccctcccagcatctgctgcgatggcctcaaggcctctccagtcccctgctgcaccatgccactcagagcccctgagtgagccccctggaattgtctgcaccccccaagccccaacaggaagaagggaaaggtggggaagctgacgctcactcagtgcccactgggtgccaggctctgggctcaaccctctaatatccacacattccatccccccagccccatgtagatggtggggttaagaccattcttcagatgtggaaatgaaggctctgggagaccacaggacatgcccaaggcaaagagttggtagtccctggatttgggaatcaaactcaagcccatctaatccaagggtaggaaatgtctctaaaacgttgatcaatctgaagcttacagattggaaactgggccaggtcagccctggcggtggagtccagagacagagagaaggctgcagggaggggagagaacaggaggatcccgggccagggtgacttcagtgacattccttccctccttcacaagcacgaaaaactcgttcggagaaaagacagcttctgccttccctaccaggcggacagggtactcactgtgccgacgtgagcagacacagccagaggctcaagtgcccttgccgagtgtccccactgctcttggggaggccccggcacagccctgcagagatgcaagtaagagagtgcccagtgccctcggcagatgggtggcagaaagcaggaggaggaagagggagctgaccgatgccgggtgtcttactccgctgagatcagaacctccaacatgccgagcagacgcaggccacattgctcggggaacaggacaccagggcgctgtgctagcggcccgcagacttcacttctggctcctgtgagggcactgtattgtccagacgcttggcaacgactctgcctgcaagtggcaaataccaacataaccacatcttccttttagttgccacaaatattcagttttgttttatccatcatgtcccccatatgcatgtaatgaaacatttgtgaaaatcactttaataataaacaggaaatgaacct

SEQ ID NO: 18508 - DNA, 524 bp, Homo sapiens
  ENST00000449304
ccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgcc

SEQ ID NO: 18509 - DNA, 2258 bp, Homo sapiens
  ENST00000290460
ggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaaggtcagcatgtggagctgtgtgggtgcccctgcctgtactggcctggccaagagcctccgtgtgcttgcatagccgggcccagggctgggctgaacgggggccacgtgtagctgtgggaaaggacacgtggcaatcatttgctttgctgttggagaggccaggaagagggagggctggccagcagcagggtccccagcagagttcgagagaacacaggtcccacggcacatcagcaggttcctgggccaaaaaggcactgatgtcagagaatttggctgcacgctgggttaaacagttaagccagcgtctctactgtgggacttcctgggccctcagtgatagtgtggcttcccaaggcgcgtagaatgtagcgcgtttccgaaccccttgacctttggttgcagtgggtcttgcagagctgatggggacagtctggtgttgggccatctgggacacacaggtctactcatgccaggaaaaataaggacagtgtgtcactactaggggggcgaggctagggggatcccatctgaaaagataaggactcaggacttctgcttgccatcagaaaatgaggagtcaggaagacctgagagtgactggttgaaggaaggagggacagggctggcctgctggtggctggcagtgagggaaggcagaggtgtatcctcccacttgtcccctgagtcaccccacaaagacttactgagtacctcctgggttgaggggaccctcaggaaacaggaagcccagggagctgggagaggagagctgggtgggctctcgagacagccctgcagatgaggaggtccagctacccccaaaggacagacggagccccaagaagctgtgggccctggggcagggtgttaggcctgagtgccggagccctctgtgcagaagggtgaggggcagtgctcagtgcccccagcatcactccagaccaccctccaaacgcccccaccccagcgctgggcagtacccccacactctgccaggaagggagagcctagagagcagggcgtggaggggagaggaactggaacttccaaagtcccatcggggaaaatattgaaagtggaggttagggtgacttaaaatagcttgaggtggactttttttaagcctgtaaaaataaatgtatttttgtacagtgtatgacttcttccttgccaacttgctgggaagaaccgagtgattattgacagaaataacagtgcttccgcctgtttatttgaaaataaagcccttctgtggccacc

SEQ ID NO: 18510 - DNA, 489 bp, Homo sapiens
  ENST00000477991
ctccctaaatatttgtggaatgaaggggcacgccttggctttgcagggtatgttcccggcccacagggggctctccatggatctgaggagactggcagggcaggatcggaatcggcaccctggagaagctgtcgttggagacggccttggcgagacagtgtgttgcagctccagctctgtccgctgggttcagccccctcaccttacctcagtcactaacctctgtgcgctcagcgttctcagctgttaagtggacgtaacacaggttgagcatcctttatccaaaatgcttgggaccagaagtgtttccagtgttggatgttttcacatttgggaacatttgcagatacataatgaagtagcttgtggatggacccaagtctaaagatggaacgcatttgttttatatactccttgtacacatacctgaaggcaattttacatggcatttcaataattttgtgcataaaacaaagtttgtgtgaagta

SEQ ID NO: 18511 - DNA, 544 bp, Homo sapiens
  ENST00000470433
gggcacgtaagcacacaagcagttgaacgtggaaggcgttgggagccagataatacaagatgtggactcttgtggctggaacagctgggtggccttggctttgcagggtatgttcccggcccacagggggctctccatggatctgaggagactggcagggcaggatcggaatcggcaccctggagaagctgtcgttggagacggccttggcgagacagtgtgttgcagctccagctctgtccgctgggttcagccccctcaccttacctcagtcactaacctctgtgcgctcagcgttctcagctgttaagtggacgtaacacaggttgagcatcctttatccaaaatgcttgggaccagaagtgtttccagtgttggatgttttcacatttgggaacatttgcagatacataatgaagtagcttgtggatggacccaagtctaaagatggaacgcatttgttttatatactccttgtacacatacctgaaggcaattttacatggcatttcaataattttgtgcataaaacaaagtttgtgtg

SEQ ID NO: 18512 - DNA, 530 bp, Homo sapiens
  ENST00000461595
acattgacgagtgtgagaatgactactacaatgggggctgtgtccacgagtgcatcaacatcccggggaactacaggtgtacctgctttgatggcttcatgctggcacacgatggacacaactgcctggagacagggtcttgctatattgcccaggcctctggaactcctgggctcaggtgatctgcccacctcgacctcccaaagtgctgggattacaggcttgacccgccaccttacctcaggcattacttcaggaatgcttcacaaaagtggaaccactggatcaaacgaccatttggttttttatggctttctaaaagggctcagcaaagcttctgttgtgccagctggtttgtgggtgtgtggtagaggatactgggtgtcctgagtgctctggaactttccctcttaatggggtgttagccttagacctgcctgcctgtttttgtccaacccatgttggatgtcagataagtttgttgtggaaaacatctgtgagcatgtaattacaccccgaataaataccca

SEQ ID NO: 18513 - DNA, 282 bp, Homo sapiens
  ENST00000480833
acattgacgagtgtgagaatgactactacaatgggggctgtgtccacgagtgcatcaacatcccggggaactacaggtgtacctgctttgatggcttcatgctggcacacgatggacacaactgcctgggaatgcttcacaaaagtggaaccactggatcaaacgaccatttggttttttatggctttctaaaagggctcagcaaagcttctgttgtgccagctggtttgtgggtgtgtggtagaggatactgggtgtcctgagtgctctggaactttccct

SEQ ID NO: 18514 - DNA, 1119 bp, Homo sapiens
  ENST00000615096
cccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctcatcaaactgctgcgctccaaagtgtctcggttcctgcggccctacaaataaccggg

SEQ ID NO: 18515 - DNA, 3147 bp, Homo sapiens
  ENST00000254351
ggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaa

SEQ ID NO: 18516 - DNA, 1523 bp, Homo sapiens
  ENST00000403076
ttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctgtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaa

SEQ ID NO: 18517 - DNA, 646 bp, Homo sapiens
  ENST00000429035
ccgcgttggcccggggagccgggccagggctgcgtggggggcgcgggcgagcgtctgcagggccctcgggcttgccgtgggcggctcgagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctgggg

SEQ ID NO: 18518 - DNA, 558 bp, Homo sapiens
  ENST00000482879
actgctaatgtggcatctggacaagtctcagcagcgctgaccctccgtaagcgttgcctcgtgtagtagctgccagttattgagcgctttggttttttttttctttacagagtctgtctcatgggagatgaggtagggacagtcgtttctgagaccgatgtgtaaagcgccctccctgcttcccagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccag

SEQ ID NO: 18519 - DNA, 591 bp, Homo sapiens
  ENST00000447124
attataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgagtctgtctcatgggagatgaggtagggacagtcgtttctgagaccgatgtgtaaagcgccctccctgcttcccagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctgga

SEQ ID NO: 18520 - DNA, 3291 bp, Homo sapiens
  ENST00000381150
ttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggc

SEQ ID NO: 18521 - DNA, 6392 bp, Homo sapiens
  ENST00000336798
gcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatg

SEQ ID NO: 18522 - DNA, 1580 bp, Homo sapiens
  ENST00000339394
gctgtgggcgcggagctgcgaggcggagccgggcggccgagccgggagcccgcgagcctagagcgcgtcggtccagccgccgggccgcgccgccgccaagcagccgccccgcgcgccgcgcctcgggaacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagc

SEQ ID NO: 18523 - DNA, 589 bp, Homo sapiens
  ENST00000471567
gtctaggagcgatgtgtgtttagggaacatacgtggccatggcggtgggtccgtgttgtgggccttggtgaggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacag

SEQ ID NO: 18524 - DNA, 355 bp, Homo sapiens
  ENST00000487984
ctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggcatgctgacacgctgagccctctgtggctgcttttagatgtgcagtcaagatgaaaaatgaccagtttctaagagaaagtcatcagccagacactgaaagccttctgggatgggaccccaggcccagcgctggcgcagtgagaacttcgagagacccgtggacctggagggctctggggatgatga

SEQ ID NO: 18525 - DNA, 2613 bp, Homo sapiens
  ENST00000372733
actcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaa

SEQ ID NO: 18526 - DNA, 10397 bp, Homo sapiens
  ENST00000404826
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 18527 - DNA, 7606 bp, Homo sapiens
  ENST00000389531
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacac

SEQ ID NO: 18528 - DNA, 554 bp, Homo sapiens
  ENST00000426596
caggagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgcaa

SEQ ID NO: 18529 - DNA, 494 bp, Homo sapiens
  ENST00000478527
aggagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatccaaa

SEQ ID NO: 18530 - DNA, 493 bp, Homo sapiens
  ENST00000484011
atcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgatgtgagtactgagacgtttggtgttagccagtccgcggttttctccgttactgtgcccctgttagtgactgccacttcacaagtgtcacgcccggcttgtgtcccaagtcagcggtcagaggccagcgcatcatgctgcataactacatatatggacaaggtttttttgtggtttctttcaacttcggaattgagaagtttcgtttttggtgta

SEQ ID NO: 18531 - DNA, 3113 bp, Homo sapiens
  ENST00000476701
gggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 18532 - DNA, 433 bp, Homo sapiens
  ENST00000481856
cctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgatcagatcctgtccctatccctctccgggcccagcgtgccgcaggtaatgagagcaacgccattccttcggccaaggagaccacagaacctcaccctcctcgctggctggtgactttaaagagttccctgacttc

SEQ ID NO: 18533 - DNA, 2108 bp, Homo sapiens
  ENST00000466611
atttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacac

SEQ ID NO: 18534 - DNA, 558 bp, Homo sapiens
  ENST00000467827
ttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacga

SEQ ID NO: 18535 - DNA, 10258 bp, Homo sapiens
  ENST00000615806
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgccccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 18536 - DNA, 6459 bp, Homo sapiens
  ENST00000251170
gggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgaggggagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatactgag

SEQ ID NO: 18537 - DNA, 576 bp, Homo sapiens
  ENST00000587469
agtcactcctcgccccaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgag

SEQ ID NO: 18538 - DNA, 4030 bp, Homo sapiens
  ENST00000280551
agccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 18539 - DNA, 3915 bp, Homo sapiens
  ENST00000505134
cttgtgtctcaacacagcagattatgttccctcagttccaccattctatttccaacatctggaccacattggaagaagactggaccactatgagaaaccagagttatctctaggatcttatgaatatgttgccactttggattattgcagacagtattcacaatagccaaaaggaggaagcaaccaggtgtctatggaagaagaatggataagcaaaatgtggtatatacgtacaatggaatatcattcagcctcaaaaaggaagaaaagtctgacccatgctacaacatggatgaatgttgaggatgttatgctaagtaaaataagccagccacaaaaaggataaatatggaatgattctatatgaggtcactaaagttgtttgcctgtggctctcttttctaaatattttgtaagatgcaactgaaggatcacttcctaaaagctgtttgaacaccagccagtaaagggaccaacaactaaaaaacatgttcgtagcagctgctttatgtcacagtgattattttaaacagataaagaaaacgcctgacgttctatgttaccgcaaatatgtaaaaaactagaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggcaaaaaaaaaaaaaaaaaaaaaaagacatataactagaaacaagataaattaggctgggtgcagtggctcacacttgtaatcctagcactttgggaggccaagacaggaggattgcttgaggccagcagttgaaggccagcctgggcaacatatcgaaacctccacctctactaaaaataaaaacttagccaggtgtagtggtacatgcctatagtcccagccactcaggaggctgaggcaagaggatccctggaacccaggagcttgaggatgcagcgagctatgattgtgccaccatactctagcctggatgacaaacttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtat

SEQ ID NO: 18540 - DNA, 2626 bp, Homo sapiens
  ENST00000511481
accagagccaggcccatgctgtggatcagaagcgaccataaacaagaaaatccaatctgtcttctggctttcttgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataacctt

SEQ ID NO: 18541 - DNA, 422 bp, Homo sapiens
  ENST00000502830
attgtcttctgtcaattatgggaatgggtgccaataatttttagtgcattttccccacagttttggttttcaggtaatgaactacaccaatgttcaagtacatggttttatgtttttaacattatgataatctcatattgctacttctatctaaatgttataaactgtactaaaactttgattttcttaaatctaagacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgctt

SEQ ID NO: 18542 - DNA, 2969 bp, Homo sapiens
  ENST00000511715
atcatttaattatcataacccaattatgaagtagatatactattattccatattcagctaaaaaaaaaaaacactgagaaaaagacagggtaagtaatttgcccagggtcacacacctgctaaaagacagagctgggattgcatcctaagcagtgagtgggtagtgctgataacagctacaccagactgctgtagcactagataaaataaaaacaactgctgctctttgaatgcctactctgtgccagttactgtgtgctctaggtgttttacatgggttaccagttaatccttacatccttacaagttcagaagcaaataatgtttcagtcttacagatgaagctcagggaattgttctcagtaaagatcaagcgtatgaaacaaaaaattgtctttttcagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatggtaagtattattttcattgcttttgtggtaatatgaaaaatataaattcgtaaatgtttttatttatgtgcagtcaaatattacagaaagaaaaataataaggcatatatttctgtatatgaaagaaataatttcatgttttgatcaatatcaattagctggtataaagttatttgtatagagtactttcaaacaactaaaatatgtgactttaatagaaaatgctaacacttccagatcattaactatgtgccagtctctgtactctaaatacttaaatataccatttcagttaattgtcataacaaatcagtgagatggatatggtctcaacattttacagaggaatcagttgaggcttggagacaagttccttcaggtagtaaagtggcagagatgggaactgaattcagttcttatgctctggactcatccctggtgctgaactgcatactcagaagaatgtagaaatctttcataagtgtttggctacagactaaatcagattactgagttaacaaataataattccataaaaagagactatacacccctctgttgcaataacaacaaaagaaattgtgagtttgatgttaaattaatacaaatgactattttaaagtatcttaggaaaacccagcttataatttgtacaagagtcaacatttattgcaaacgttatttgtagaccattgttgtgtgagcatcactgccgatggctattgtttgactctgatagtggattccagtagagctcagcagatagttagtttcctgaaggctcacttacattgtggcaagatggcttaagtctagttgttgaacccaattgtatgaagtacagtttatcaatatatatagcatcttgcagaaagaggcaagattaaaattcaaggccatgacaggtgatcagtttagagagctgcatattcatgaggaatgtcaaaagtgtatttttaagagaattcaggggcatcaatattccagttagagattggttttaagatgaagatttagaaattgatatctgcatatgtttgaaattaagaaatgattataaatgcaatttaaaaaaataaaattcagtaggcaaagaactatgagtctgaagaatgtttatataaaagttaaggaagcttcctcttgtaatatattgacatagtaaatgctgaatgcatagttgctgaactgaacatccacaggaaatagccagtgtctctaccacaaggcagcagattggtaggtctgtgcttatatcagcatactggtatttccttgactttcatcaacaaaatgaaacaaagttaaaaaccaaatgtaagctactttctttttagaggcagctggcactttaaaacacatacatgaagaatacttacgttgtttgttgaataaatagatctaccataatatgccacataatgcatataggggatgggagtgtgaatgtaaataatgaattttttgctttccttactcctgtgaaaaacattgaccataaacttttcctgacacttgaggtttatggtgaaacattctaactcacatgttctctggccaactcacagtgatgcattggctgttggcatcttcttgctgagaagcaaacattagcattttactctgtcttaacggaagaaatgtaagtcaaaatccttcatatcacctggatgccacgtgcagctggattggcctgtagaccactaaccagatttctgggctatctaagacgctgcattccctttgagaaatcaacatttggtagtttgttttaatgccggaacagtagtacttggatggaattttccatccactgaaggaacaaagtacattcttttctctcgcaacatagccttgaatcttgaaaagggatcaaactttcacaggaagttgtttgcataaaacatatactattgtctcttggtatccatggggaattggttccagaatactctataaattaacagatgctgaagtccctcatataaaatggcatggtatttgcatataacttgtacatatacccccatatattttaaatcatctctagattacttataacaccagctgggcacggtggctcacacctataatcccagcactttgggaggctgaagcgggaggattgcttgagtgcaggcgttcaagaccagcctgggcaacatagtgagaccctctctctatcaaaaaaaaa

SEQ ID NO: 18543 - DNA, 3806 bp, Homo sapiens
  ENST00000514561
atggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagacagtattcacaatagccaaaaggaggaagcaaccaggtgtctatggaagaagaatggataagcaaaatgtggtatatacgtacaatggaatatcattcagcctcaaaaaggaagaaaagtctgacccatgctacaacatggatgaatgttgaggatgttatgctaagtaaaataagccagccacaaaaaggataaatatggaatgattctatatgaggtcactaaagttgtttgcctgtggctctcttttctaaatattttgtaagatgcaactgaaggatcacttcctaaaagctgtttgaacaccagccagtaaagggaccaacaactaaaaaacatgttcgtagcagctgctttatgtcacagtgattattttaaacagataaagaaaacgcctgacgttctatgttaccgcaaatatgtaaaaaactagaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggcaaaaaaaaaaaaaaaa

SEQ ID NO: 18544 - DNA, 351 bp, Homo sapiens
  ENST00000502526
actgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccaggtgagctacctattgcacatagatgttaaagtgttacaaacgactactcatttcttcagcacatagctatagaaggcttatgatgttgcaggcacttagatgctgttacagtaaacagtgtagctgagaagattaagaatgcaatttgggggggctg

SEQ ID NO: 18545 - DNA, 576 bp, Homo sapiens
  ENST00000511033
ctcagttagtgaaggaagtagagaagaaaacacagttcagagtcagtaccttatcagcctgtactctgttgacatatcaaagaaattgggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctct

SEQ ID NO: 18546 - DNA, 1870 bp, Homo sapiens
  ENST00000509818
atatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaaggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttttagaggaaaaaatcctgagaagggacagaggcttctcccaaagcatttggacaaagtcctccagcgagcccaccagctcctcagatgtcttcacccaagcccccagctttcttagaaaggtgaccaaaatcatacccaccatgaagagcagcaaggatcttcagtttgctgtgactctttggcctcctacccaaagtgtcggctcagggccttaaaaggcccagccacttccaggaagagaaaaacgactcagaattcttgtgtctcaacacagcagattatgttccctcagttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgt

SEQ ID NO: 18547 - DNA, 580 bp, Homo sapiens
  ENST00000514418
acatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagagtaagtgttcccagaacttcaagtgtttatacattgatgttaaattcaagtgaataactttcatatgtaaagaactgactcttgattcacaaacaaagcattttggtggtaccatggagtggtagaaatgcctaagacacagatcccatctcctaggttgttaacatgattcaactgccaaaccatctactggaggaattatttttaaaaactgaaatgtggtgtcagaaatagaaaacaataattttttatgtccttgccagacagaatatacctggttcttaatgcagtagttccgtacagtgcctctgcctcccttattttgtaaagagtctcagaaaaacttcccttccaagagaaaagctcaaccaaaatggttagtaggacta

SEQ ID NO: 18548 - DNA, 1319 bp, Homo sapiens
  ENST00000506622
aagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatgatcatggaaagagtggaagctcagatgttgtgaggcagaaaagagaagataggagaggaaagagtcacagtactgagatttacatcaacagaaatgctgtatatcctgttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgag

SEQ ID NO: 18549 - DNA, 602 bp, Homo sapiens
  ENST00000503683
gtagtgcattgcacgggtacgtcatcaaatgtgcgtgtacacgtgccagattcgcctttaaacgacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcc

SEQ ID NO: 18550 - DNA, 561 bp, Homo sapiens
  ENST00000505280
aagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtacagtgtgttattttgacttgtatgtgattattcagttctcaggctcagagacataagatgttctgaaagaggagatttgaaagcattgaatgatcattatataatgaaatggcttgagattacaggatcatttggaaaaggctctcatagcagaactctacatcactagtttggttattgcatgcaatacaagtttggtttttaaatatagactaaaacaaacacttcctgttttatttttactgtgagtcttgttcttgctgttaattagtggtgtaaggctattgtaaacattgaat

SEQ ID NO: 18551 - DNA, 2786 bp, Homo sapiens
  ENST00000419654
gcggctggtccaagcccggcgctgggggcgcgcagccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataa

SEQ ID NO: 18552 - DNA, 4520 bp, Homo sapiens
  ENST00000399878
cggcaggtggccccgcgcgcggcggccggcccggccgggggcgggcgggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgactacca

SEQ ID NO: 18553 - DNA, 4369 bp, Homo sapiens
  ENST00000264868
tcaaaatccatcctgaaggcctgggagccgggcagctgcgcggcacaactccagggggcacactcgccctgcgccctgcgggaatggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattga
